US008834863B2

(12) United States Patent
Roy et al.

(10) Patent No.: US 8,834,863 B2
(45) Date of Patent: Sep. 16, 2014

(54) SUBFAMILY E SIMIAN ADENOVIRUSES A1321, A1325, A1295, A1309, A1316 AND A1322 AND USES THEREOF

(75) Inventors: Soumitra Roy, Leiderdorp (NL); James M. Wilson, Glen Mills, PA (US)

(73) Assignee: The Trustees of the University of Pennsylvania, Philadelphia, PA (US)

( * ) Notice: Subject to any disclaimer, the term of this patent is extended or adjusted under 35 U.S.C. 154(b) by 32 days.

(21) Appl. No.: 13/475,535

(22) Filed: May 18, 2012

(65) Prior Publication Data
US 2013/0004461 A1    Jan. 3, 2013

Related U.S. Application Data

(63) Continuation-in-part of application No. PCT/US2011/061632, filed on Nov. 21, 2011.

(60) Provisional application No. 61/416,499, filed on Nov. 23, 2010, provisional application No. 61/416,515, filed on Nov. 23, 2010, provisional application No. 61/416,467, filed on Nov. 23, 2010, provisional application No. 61/416,481, filed on Nov. 23, 2010, provisional application No. 61/416,491, filed on Nov. 23, 2010, provisional application No. 61/416,509, filed on Nov. 23, 2010.

(51) Int. Cl.
| | |
|---|---|
| *C12N 15/861* | (2006.01) |
| *C12N 7/01* | (2006.01) |
| *C07K 14/075* | (2006.01) |
| *C12N 15/33* | (2006.01) |

(52) U.S. Cl.
USPC ......... 424/93.6; 435/456; 435/69.1; 435/320; 435/91.1; 424/186.1; 424/233.1

(58) Field of Classification Search
CPC .. C12N 15/861; C12N 15/8613; C12N 15/62; C12N 15/13044; C12N 15/10021; C12N 15/10043; C07K 14/075
See application file for complete search history.

(56) References Cited

U.S. PATENT DOCUMENTS

| | | | |
|---|---|---|---|
| 6,083,716 | A | 7/2000 | Wilson |
| 7,247,472 | B2 | 7/2007 | Wilson et al. |
| 7,291,498 | B2 | 11/2007 | Roy et al. |
| 7,491,508 | B2 | 2/2009 | Roy et al. |
| 8,231,880 | B2 | 7/2012 | Roy et al. |
| 2005/0069866 | A1 | 3/2005 | Wilson et al. |
| 2008/0090281 | A1 | 4/2008 | Wilson et al. |
| 2009/0074810 | A1 | 3/2009 | Roy et al. |
| 2009/0215871 | A1 | 8/2009 | Wilson et al. |
| 2011/0217332 | A1* | 9/2011 | Colloca et al. ............ 424/233.1 |

FOREIGN PATENT DOCUMENTS

| | | |
|---|---|---|
| EP | 2012822 | 1/2009 |
| WO | WO 99/29334 | 6/1999 |
| WO | WO 03/000851 | 1/2003 |
| WO | WO 03/046124 | 6/2003 |
| WO | WO 2005/001103 A2 | 1/2005 |
| WO | WO 2005/071093 A2 | 8/2005 |
| WO | WO 2009/073104 A3 | 8/2009 |
| WO | WO 2009/105084 | 12/2009 |
| WO | WO 2010/085984 | 8/2010 |

OTHER PUBLICATIONS

Russell et al, Replicating Vectors for Gene Therapy of Cancer, Risks, Limitations and Prospects, Eur J Cancer, 1994, pp. 1165-1171.*
Thomas et al, Progress and Problems with the use of Viral Vectors for Gene Therapy, Nature 2003, pp. 346-359.*
Crompton, Expression of a foreign epitope on the surface of the adenovirus hexon, J. General Virology, 75:133-139, 1994.
Farina, Replication-Defective Vector Based on a Chimpanzee Adenovirus, Journal of Virology, 75(23):11603-11613, Dec. 1, 2001.
Hong, Domains required for assembly of adenovirus type 2 fiber trimers, J. Virol., 70: 7071-7078, 1996.
Khare, Advances and Future Challenges in Adenoviral Vector Pharmacology and Targeting, Curr. Gene Ther., 11(4): 241-258, Aug. 2011.
McCoy, Effect of Preexisting Immunity to Adenovirus Human Serotype 5 Antigens on the Immune Responses of Nonhuman Primates to Vaccine Regimens Based on Human- or Chimpanzee-Derived Adenovirus Vectors, J. Virol., 81(12):6594-6604, Apr. 11, 2007 (Epub).
Mercier, A chimeric adenovirus vector encoding reovirus attachment protein sigma1 targets cells expressing junctional adhesion molecule 1, Proc Natl Acad Sci U S A., 101(16):6188-93, Apr. 20, 2004, Epub Apr. 12, 2004.
Roy, Characterization of a Family of Chimpanzee Adenoviruses and Development of Molecular Clones for Gene Transfer Vectors, Human Gene Therapy, 15(5):519-530, May 1, 2004.
Roy, Complete Nucleotide Sequences and Genome Organization of Four Chimpanzee Adenoviruses, Virology, 324(2):361-372, Jul. 1, 2004.
Roy, Generation of an Adenoviral Vaccine Vector Based on Simian Adenovirus 21, Journal of General Virology, 87(9):2477-2485, Sep. 2006.
Roy, Isolation and Characterization of Adenoviruses Persistently Shed from the Gastrointestinal Tract of Non-Human Primates, PLOS, Pathogens, 5(7):1-9, Jul. 1, 2009.
Roy, Partial Protection against H5N1 Influenza in Mice with a Single Dose of a Chimpanzee Adenovirus Vector Expressing Nucleoprotein, Vaccine, 25(39-40):6845-6851, Sep. 15, 2007.

(Continued)

*Primary Examiner* — Maria Marvich
(74) *Attorney, Agent, or Firm* — Howson & Howson LLP

(57) ABSTRACT

Recombinant vectors comprise simian adenovirus A1321 (SAdV-A1321), SAdV-A1325, SAdV-A1295, SAdV-A1309, SAdV-A1316, and/or SAdV-A1322 sequences and a heterologous gene under the control of regulatory sequences. A cell line which expresses simian adenovirus SAdV-A1321, SAdV-A1325, SAdV-A1295, SAdV-A1309, SAdV-A1316, and/or SAdV-A1322 gene(s) is also disclosed. Methods of using the vectors and cell lines are provided.

10 Claims, No Drawings

(56) References Cited

OTHER PUBLICATIONS

Roy, Rescue of Chimeric Adenoviral Vectors to Expand the Serotype Repertoire, Journal of Virological Methods, 141(1):14-21, Feb. 21, 2007.
Russell, W.C., Update on Adenovirus and its Vectors, Journal of General Virology, 81:2573-2604, Nov. 2000.
Shenk, T., Adenoviridae: The Viruses and Their Replication, Fields Virology, Third Edition, Chapter 67, pp. 2111-2112, 1996.
Tatsis, Chimpanzee-origin adenovirus vectors as vaccine carriers, Gene Ther., 13(5):421-9, Mar. 2006 (Epub Dec. 1, 2005).
Vigne, RGD Inclusion in the Hexon Monomer Provides Adenovirus Type 5-Based Vectors with a Fiber Knob-Independent Pathway for Infection, J. Virol., vol. 73, No. 6, 5156-5161, Jun. 1999.
Wu, Identification of sites in adenovirus hexon for foreign peptide incorporation, J Virol., 79(6):3382-90, Mar. 2005.

\* cited by examiner

SUBFAMILY E SIMIAN ADENOVIRUSES A1321, A1325, A1295, A1309, A1316 AND A1322 AND USES THEREOF

CROSS-REFERENCE TO RELATED APPLICATIONS

This application is a continuation-in-part of PCT/US2011/061632, filed Nov. 21, 2011, which claims the benefit under 35 USC 119(e) of U.S. Patent Application Nos. 61/416,499, filed on Nov. 23, 2010, 61/416,515, filed on Nov. 23, 2010, 61/416,467, filed on Nov. 23, 2010, 61/416,481, filed on Nov. 23, 2010, 61/416,491, filed on Nov. 23, 2010, and 61/416,509, filed on Nov. 23, 2010, all of which are incorporated by reference herein.

INCORPORATION-BY-REFERENCE OF MATERIAL SUBMITTED IN ELECTRONIC FORM

Applicant hereby incorporates by reference the Sequence Listing material filed in electronic form herewith. This file is labeled "UPN_X5708PCT_CIP01_US_ST25.txt".

BACKGROUND OF THE INVENTION

Adenovirus is a double-stranded DNA virus with a genome size of about 36 kilobases (kb), which has been widely used for gene transfer applications due to its ability to achieve highly efficient gene transfer in a variety of target tissues and large transgene capacity. Conventionally, E1 genes of adenovirus are deleted and replaced with a transgene cassette consisting of the promoter of choice, cDNA sequence of the gene of interest and a poly A signal, resulting in a replication defective recombinant virus.

Adenoviruses have a characteristic morphology with an icosahedral capsid consisting of three major proteins, hexon (II), penton base (III) and a knobbed fibre (IV), along with a number of other minor proteins, VI, VIII, IX, Ina and IVa2 [W. C. Russell, *J. Gen Virol.*, 81:2573-3704 (November 2000)]. The virus genome is a linear, double-stranded DNA with a terminal protein attached covalently to the 5' terminus, which have inverted terminal repeats (ITRs). The virus DNA is intimately associated with the highly basic protein VII and a small peptide pX (formerly termed mu). Another protein, V, is packaged with this DNA-protein complex and provides a structural link to the capsid via protein VI. The virus also contains a virus-encoded protease, which is necessary for processing of some of the structural proteins to produce mature infectious virus.

A classification scheme has been developed for the Mastadenovirus family, which includes human, simian, bovine, equine, porcine, ovine, canine and opossum adenoviruses. This classification scheme was developed based on the differing abilities of the adenovirus sequences in the family to agglutinate red blood cells. The result was six subgroups, now referred to as subgroups A, B, C, D, E and F. See, T. Shenk et al., *Adenoviridae: The Viruses and their Replication*", Ch. 67, in FIELD'S VIROLOGY, 6th Ed., edited by B. N Fields et al, (Lippincott Raven Publishers, Philadelphia, 1996), p. 111-2112.

Recombinant adenoviruses have been described for delivery of heterologous molecules to host cells. See, U.S. Pat. No. 6,083,716, which describes the genome of two chimpanzee adenoviruses. Simian adenoviruses, C5, C6 and C7, have been described in U.S. Pat. No. 7,247,472 as being useful as vaccine vectors. Other chimpanzee adenoviruses are described in WO 2005/1071093 as being useful for making adenovirus vaccine carriers.

What is needed in the art are vectors which effectively deliver molecules to a target and minimize the effect of pre-existing immunity to selected adenovirus serotypes in the population.

SUMMARY OF THE INVENTION

Isolated nucleic acid sequences and amino acid sequences of six novel subfamily E simian adenoviruses, and vectors containing these sequences, are provided herein. Also provided are a number of methods for using the vectors and cells of the invention. These adenoviruses include SAdV-A1321, SAdV-A1325, SAdV-A1295, SAdV-A1309, SAdV-A1316, and SAdV-A1322.

The methods described herein involve delivering one or more selected heterologous gene(s) to a mammalian patient by administering a vector of the invention. Use of the compositions described herein for vaccination permits presentation of a selected antigen for the elicitation of protective immune responses. The vectors based on these simian adenoviruses may also be used for producing heterologous gene products in vitro. Such gene products are themselves useful for a variety of purposes such as are described herein.

These and other embodiments and advantages of the invention are described in more detail below.

DETAILED DESCRIPTION OF THE INVENTION

Novel nucleic acid and amino acid sequences from simian adenovirus A1321, SAdV-A1325, SAdV-A1295, SAdV-A1309, SAdV-A1316, and SAdV-A1322, all of which were isolated from chimpanzee feces, are provided.

Also provided are novel adenovirus vectors and packaging cell lines to produce vectors based on these sequences for use in the in vitro production of recombinant proteins or fragments or other reagents. Further provided are compositions for use in delivering a heterologous molecule for therapeutic or vaccine purposes. Such therapeutic or vaccine compositions contain the adenoviral vectors carrying an inserted heterologous molecule. In addition, the novel SAdV sequences are useful in providing the essential helper functions required for production of recombinant adeno-associated viral (AAV) vectors. Thus, helper constructs, methods and cell lines which use these sequences in such production methods, are provided.

The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 95 to 99%, including about 96%, about 97%, about 98%, and about 99% of the aligned sequences.

The term "substantial homology" or "substantial similarity," when referring to amino acids or fragments thereof, indicates that, when optimally aligned with appropriate amino acid insertions or deletions with another amino acid (or its complementary strand), there is amino acid sequence identity in at least about 95 to 99% %, including about 96%, about 97%, about 98%, and about 99%, of the aligned sequences. Preferably, the homology is over full-length sequence, or a protein thereof, or a fragment thereof which is at least 8 amino acids, or more desirably, at least 15 amino acids in length. Examples of suitable fragments are described herein.

The term "percent sequence identity" or "identical" in the context of nucleic acid sequences refers to the residues in the two sequences that are the same when aligned for maximum correspondence. Where gaps are required to align one sequence with another, the degree of scoring is calculated with respect to the longer sequence without penalty for gaps. Sequences that preserve the functionality of the polynucleotide or a polypeptide encoded thereby are more closely identical. The length of sequence identity comparison may be over the full-length of the genome (e.g., about 36 kbp), the full-length of an open reading frame of a gene, protein, subunit, or enzyme [see, e.g., the tables providing the adenoviral coding regions], or a fragment of at least about 500 to 5000 nucleotides, is desired. However, identity among smaller fragments, e.g. of at least about nine nucleotides, usually at least about 20 to 24 nucleotides, at least about 28 to 32 nucleotides, at least about 36 or more nucleotides, may also be desired. Similarly, "percent sequence identity" may be readily determined for amino acid sequences, over the full-length of a protein, or a fragment thereof. Suitably, a fragment is at least about 8 amino acids in length, and may be up to about 700 amino acids. Examples of suitable fragments are described herein.

Identity is readily determined using such algorithms and computer programs as are defined herein at default settings. Preferably, such identity is over the full length of the protein, enzyme, subunit, or over a fragment of at least about 8 amino acids in length. However, identity may be based upon shorter regions, where suited to the use to which the identical gene product is being put.

As described herein, alignments are performed using any of a variety of publicly or commercially available Multiple Sequence Alignment Programs, such as "Clustal W", accessible through Web Servers on the internet [Thompson et al, 1994, *Nucleic Acids Res*, 22, 4673-4680]. Alternatively, Vector NTIO utilities [InVitrogen] are also used. There are also a number of algorithms known in the art that can be used to measure nucleotide sequence identity, including those contained in the programs described above. As another example, polynucleotide sequences can be compared using Fasta, a program in GCG Version 6.1. Fasta provides alignments and percent sequence identity of the regions of the best overlap between the query and search sequences. For instance, percent sequence identity between nucleic acid sequences can be determined using Fasta with its default parameters (a word size of 6 and the NOPAM factor for the scoring matrix) as provided in GCG Version 6.1, herein incorporated by reference. Similarly programs are available for performing amino acid alignments. Generally, these programs are used at default settings, although one of skill in the art can alter these settings as needed. Alternatively, one of skill in the art can utilize another algorithm or computer program that provides at least the level of identity or alignment as that provided by the referenced algorithms and programs.

"Recombinant", as applied to a polynucleotide, means that the polynucleotide is the product of various combinations of cloning, restriction or ligation steps, and other procedures that result in a construct that is distinct from a polynucleotide found in nature. A recombinant virus is a viral particle comprising a recombinant polynucleotide. The terms respectively include replicates of the original polynucleotide construct and progeny of the original virus construct.

Typically, "heterologous" means derived from a genotypically distinct entity from that of the rest of the entity to which it is being compared. A heterologous nucleic acid sequence refers to any nucleic acid sequence that is not isolated from, derived from, or based upon a naturally occurring nucleic acid sequence of the adenoviral vector. "Naturally occurring" means a sequence found in nature and not synthetically prepared or modified. A sequence is "derived" from a source when it is isolated from a source but modified (e.g., by deletion, substitution (mutation), insertion, or other modification) so as not to disrupt the normal function of the source gene. A sequence is "based upon" a source when the sequence is substantially similar to the source.

For example, a polynucleotide introduced by genetic engineering techniques into a plasmid or vector derived from a different species (and often a different genus, subfamily or family) is a heterologous polynucleotide. A promoter removed from its native coding sequence and operatively linked to a coding sequence with which it is not naturally found linked is a heterologous promoter. A specific recombination site that has been cloned into a genome of a virus or viral vector, wherein the genome of the virus does not naturally contain it, is a heterologous recombination site. A heterologous nucleic acid sequence also includes a sequence naturally found in an adenoviral genome, but located at a non-native position within the adenoviral vector. When a polynucleotide with an encoding sequence for a recombinase is used to genetically alter a cell that does not normally express the recombinase, both the polynucleotide and the recombinase are heterologous to the cell.

A heterologous vaccine refers to the situation where one virus or viral vector is introduced in order to induce immunity against a pathogenic virus of another species. In this case, the term "heterologous" refers an inoculating antigen and challenge antigen derived from viruses having different species, genus, subfamily, or family specificity.

As used throughout this specification and the claims, the term "comprise" and its variants including, "comprises", "comprising", among other variants, is inclusive of other components, elements, integers, steps and the like. The term "consists of" or "consisting of" are exclusive of other components, elements, integers, steps and the like.

I. The Simian Adenovirus Sequences

The invention provides nucleic acid sequences and amino acid sequences of simian adenovirus A1321 (SAdV-A1321), SAdV-A1325, SAdV-A1295, SAdV-A1309, SAdV-A1316, and SAdV-A1322, which are each isolated from the other material with which they are associated in nature.

A. Nucleic Acid Sequences

The SAdV-A1321 nucleic acid sequences provided herein include nucleotides 1 to 36546 of SEQ ID NO:1. The SAdV-A1325 nucleic acid sequences herein include nucleotides 1 to 36542 of SEQ ID NO:28. The SAdV-A1295 nucleic acid sequences provided herein include nucleotides 1 to 36643 of SEQ ID NO:57. The SAdV-A1309 nucleic acid sequences provided herein include nucleotides 1 to 36528 of SEQ ID NO:86. The SAdV-A1316 nucleic acid sequences provided herein include nucleotides 1 to 36667 of SEQ ID NO:114. The SAdV-A1322 nucleic acid sequences provided herein include nucleotides 1 to 36770 of SEQ ID NO:139. See, Sequence Listing, which is incorporated by reference herein.

In one embodiment, the nucleic acid sequences of the invention further encompass the strands which are complementary to the sequences of SEQ ID NO: 1, 28, 57, 86, 114, or 139, respectively, as well as the RNA and cDNA sequences corresponding to the sequences and their complementary strands. In another embodiment, the nucleic acid sequences further encompass sequences which are greater than 98.5% identical, and preferably, greater than about 99% identical, to the Sequence Listing. Also included in one embodiment, are natural variants and engineered modifications of the sequence provided in SEQ ID NO: 1, 28, 57, 86, 114, or 139 and their complementary strands. Such modifications include, for example, labels that are known in the art, methylation, and substitution of one or more of the naturally occurring nucleotides with a degenerate nucleotide.

TABLE 1

NUCLEIC ACID REGIONS

| Regions | | SAdV-A1321 ORF SEQ ID NO: 1 | SAdV-A1325 ORF SEQ ID NO: 28 | SAdV-A1295 ORF SEQ ID NO: 57 | SAdV-A1309 ORF SEQ ID NO: 86 | SAdV-A1316 ORF SEQ ID NO: 114 | SAdV-A1322 ORF SEQ ID NO: 139 |
|---|---|---|---|---|---|---|---|
| | ITR | 1 ... 129 | 1 ... 129 | 1 ... 127 | 1 ... 129 | 1 ... 128 | |
| E1a | 13S 12S 9S | (576 ... 1140, 1234 ... 1439) | (882 ... 1146, 1234 ... 1439) | (577 ... 1141, 1235 ... 1440) | (576 ... 1143, 1228 ... 1433) | (577 ... 1144, 1229 ... 1434) | (576 ... 1140, 1234 ... 1439) |
| E1b | Small T/19K | 1601 ... 2155 | 1604 ... 2173 | 1602 ... 2153 | 1599 ... 2177 | | 1605 ... 2186 |
| | Large T/55K | 1906 ... 3396 | 1909 ... 3414 | 1907 ... 3394 | 1904 ... 3418 | 1905 ... 3416 | 1910 ... 3427 |
| | IX | 3484 ... 3909 | 3452 ... 3922 | 3481 ... 3906 | 3456 ... 3926 | 3504 ... 3929 | 3512 ... 3940 |
| E2b | pTP | Complement (8457 ... 10385, 13829 ... 13837) | Complement (8453 ... 10378, 13818 ... 13826) | Complement (8448 ... 10376, 13809 ... 13817) | Complement (8462 ... 10393, 13849 ... 13857) | Complement (8480 ... 10408, 13841 ... 13849) | Complement (8479 ... 10422, 13885 ... 13893) |
| | Polymerase | Complement (5077 ... 8655, 13829 ... 13837) | Complement (5091 ... 8651, 13818 ... 13826) | Complement (5074 ... 8646, 13809 ... 13817) | Complement (5094 ... 8660, 13849 ... 13857) | Complement (5094 ... 8678, 13841 ... 13849) | Complement (5102 ... 8680, 13885 ... 13893) |
| | IVa2 | Complement (3974 ... 5304, 5583 ... 5595) | Complement (3988 ... 5318, 5597 ... 5609) | Complement (3971 ... 5301, 5580 ... 5592) | Complement (3991 ... 5321, 5600 ... 5612) | Complement (3994 ... 5324, 5603 ... 5615) | Complement (3999 ... 5332, 5611 ... 5623) |
| L1 | 52/55D | 10809 ... 11984 | 10806 ... 11984 | 10850 ... 12022 | 10841 ... 12019 | 10873 ... 12054 | |
| | IIIa | 12025 ... 13800 | 12011 ... 13789 | 12011 ... 13780 | 12049 ... 13815 | 12046 ... 13812 | 12078 ... 13859 |
| L2 | Penton | 13885 ... 15504 | 13866 ... 15491 | 13857 ... 15458 | 13897 ... 15516 | 13897 ... 15846 | 13938 ... 15566 |
| | VII | 15511 ... 16089 | 15498 ... 16079 | 15466 ... 16044 | 15523 ... 16104 | 15490 ... 16068 | 15570 ... 16151 |
| | V | 16134 ... 17147 | 16127 ... 17167 | 16092 ... 17195 | 16152 ... 17195 | 16113 ... 17144 | 16193 ... 17230 |
| | pX | 17174 ... 17404 | 17193 ... 17423 | 17141 ... 17371 | 17223 ... 17453 | 17168 ... 17398 | 17251 ... 17484 |
| L3 | VI | 17439 ... 18200 | 17495 ... 18220 | 17407 ... 18180 | 17525 ... 18253 | 17433 ... 18206 | 17516 ... 18289 |
| | Hexon | 18309 ... 21134 | 18260 ... 21136 | 18290 ... 21109 | 18348 ... 21164 | 18312 ... 21125 | 18396 ... 21218 |
| | Endoprotease | 21161 ... 21781 | 21161 ... 21781 | 21130 ... 21756 | 21189 ... 21809 | 21152 ... 21784 | 21240 ... 21869 |
| E2a | DBP | Complement (21862 ... 23391) | Complement (21867 ... 23399) | Complement (21838 ... 23373) | Complement (21898 ... 23433) | Complement (21864 ... 23399) | Complement (21948 ... 23486) |
| L4 | 100 kD | 23420 ... 25828 | 23425 ... 25812 | 23399 ... 25819 | 23456 ... 25843 | 23428 ... 25830 | 23509 ... 25902 |
| | 22 kD | 25545 ... 26105 | 25532 ... 26092 | 25533 ... 26096 | 25560 ... 26129 | | 25525 ... 26167 |
| | VIII | 26453 ... 27133 | 26430 ... 27110 | 26453 ... 27133 | 26469 ... 27149 | 26452 ... 27132 | 26510 ... 27190 |
| E3 | 12.5K | | 27114 ... 27431 | 27137 ... 27545 | 27153 ... 27470 | | 27194 ... 27511 |
| | CR1-alpha | 27411 ... 28046 | 27388 ... 28014 | 27411 ... 28043 | 27427 ... 28050 | 27410 ... 28042 | 27468 ... 28088 |
| | gp19K | 28031 ... 28558 | 27999 ... 28526 | 28028 ... 28555 | 28035 ... 28565 | | 28073 ... 28597 |
| | CR1-beta | 28591 ... 29193 | 28559 ... 29176 | 28589 ... 29317 | 28598 ... 29215 | 28532 ... 29323 | 28637 ... 29356 |
| | CR1-gamma | 29209 ... 29823 | 29192 ... 29800 | 29333 ... 29953 | 29231 ... 29845 | 29339 ... 29962 | 29372 ... 29992 |
| | CR1-delta | 29819 ... 30736 | 29818 ... 30681 | 29976 ... 30848 | 29863 ... 30741 | 29985 ... 30881 | 29854 ... 30891 |
| | RID-alpha | 30748 ... 31020 | 30692 ... 30964 | 30860 ... 31132 | | 30893 ... 31165 | 30902 ... 31174 |
| | RID-beta | 31029 ... 31457 | 30973 ... 31404 | 31135 ... 31572 | 31033 ... 31464 | 31174 ... 31602 | 31183 ... 31614 |
| | 14.7K | 31453 ... 31854 | 31400 ... 31804 | 31568 ... 31969 | 31460 ... 31864 | 31598 ... 31999 | 31610 ... 32014 |
| L5 | Fiber | 32117 ... 33451 | 32101 ... 33429 | 32227 ... 33552 | 32137 ... 33411 | 32253 ... 33578 | 32270 ... 33595 |
| E4 | Orf 6/7 | Complement (33550 ... 33801, 34524 ... 34697) | Complement (33543 ... 33794, 34526 ... 34696) | Complement (33646 ... 33897, 34620 ... 34793) | Complement (33523 ... 33774, 34506 ... 34676) | Complement (33671 ... 33922, 34645 ... 34818) | Complement (33722 ... 33973, 34699 ... 34884) |
| | Orf 6 | Complement (33801 ... 34697) | Complement (33794 ... 34696) | Complement (33897 ... 34793) | Complement (33774 ... 34676) | Complement (33922 ... 34818) | Complement (33970 ... 34884) |
| | Orf 4 | Complement (34790 ... 35131) | Complement (34605 ... 34967) | Complement (34669 ... 35064) | Complement (34585 ... 34947) | Complement (34911 ... 35252) | Complement (34775 ... 35140) |
| | Orf 3 | Complement (34980 ... 35530) | Complement (34980 ... 35330) | Complement (35076 ... 35426) | Complement (34960 ... 35310) | Complement (35101 ... 35451) | Complement (35149 ... 35502) |
| | Orf 2 | Complement (35330 ... 35716) | Complement (35330 ... 35716) | Complement (35426 ... 35812) | Complement (35310 ... 35696) | Complement (35451 ... 35837) | Complement (35499 ... 35888) |
| | Orf1 | Complement (35769 ... 36140) | Complement (35760 ... 36131) | Complement (35865 ... 36236) | Complement (35739 ... 36110) | Complement (35890 ... 36261) | Complement (35939 ... 36316) |
| ITR | | Complement (36418 ... 36546) | Complement (36413 ... 36542) | Complement (36517 ... 36643) | Complement (36400 ... 36528) | Complement (36540 ... 36667) | Complement (36653 ... 36674) |

In one embodiment, fragments of the sequences of SEQ ID NO: 1, 28, 57, 86, 114, or 139 and their complementary strands, cDNA and RNA complementary thereto are provided, along with fragments that have substantial homology thereto. Suitable fragments are at least 15 nucleotides in length, and encompass functional fragments, i.e., fragments which are of biological interest. For example, a functional fragment can express a desired adenoviral product or may be useful in production of recombinant viral vectors. Such fragments include the gene sequences and fragments listed in the tables herein. The tables provide the transcript regions and open reading frames in the SAdV-A1321, SAdV-A1325, SAdV-A1295, SAdV-A1309, SAdV-A1316, and SAdV-A1322 sequences. For certain genes, the transcripts and open reading frames (ORFs) are located on the strand complementary to that presented in SEQ ID NO: 1, 28, 57, 86, 114, or 139. See, e.g., E2a, E2b, and E4. The calculated molecular weights of the encoded proteins are also shown. Note that the E1a open reading frame, E2b open reading frame, and E4 open reading frame contain internal splice sites. These splice sites are noted in the table above.

The SAdV-A1321, SAdV-A1325, SAdV-A1295, SAdV-A1309, SAdV-A1316, or SAdV-A1322 adenoviral nucleic acid sequences are useful as therapeutic agents and in construction of a variety of vector systems and host cells. As used herein, a vector includes any suitable nucleic acid molecule including, naked DNA, a plasmid, a virus, a cosmid, or an episome. These sequences and products may be used alone or in combination with other adenoviral sequences or fragments, or in combination with elements from other adenoviral or non-adenoviral sequences. The SAdV-A1321, SAdV-A1325, SAdV-A1295, SAdV-A1309, SAdV-A1316, or SAdV-A1322 sequences are also useful as antisense delivery vectors, gene therapy vectors, or vaccine vectors. Thus, further provided are nucleic acid molecules, gene delivery vectors, and host cells which contain the SAdV-A1321, SAdV-A1325, SAdV-A1295, SAdV-A1309, SAdV-A1316, or SAdV-A1322 sequences.

For example, the invention encompasses a non-naturally occurring nucleic acid molecule containing simian Ad ITR sequences of the invention. "Non-naturally occurring" refers to sequences or genetic elements that cannot be found in nature and have been synthesized, rearranged, or modified through recombinant, genetic engineering, or other techniques, along with progeny from vectors and host cells containing same. In another example, the invention provides a nucleic acid molecule containing simian Ad sequences of the invention encoding a desired Ad gene product. Still other nucleic acid molecule constructed using the sequences of the invention will be readily apparent to one of skill in the art, in view of the information provided herein.

In one embodiment, the simian Ad gene regions identified herein may be used in a variety of vectors for delivery of a heterologous molecule to a cell. For example, vectors are generated for expression of an adenoviral capsid protein (or fragment thereof) for purposes of generating a viral vector in a packaging host cell. Such vectors may be designed for expression in trans. Alternatively, such vectors are designed to provide cells which stably contain sequences which express desired adenoviral functions, e.g., one or more of E1a, E1b, the terminal repeat sequences, E2a, E2b, E4, E40RF6 region.

In addition, the adenoviral gene sequences and fragments thereof are useful for providing the helper functions necessary for production of helper-dependent viruses (e.g., adenoviral vectors deleted of essential functions, or adeno-associated viruses (AAV)). For such production methods, the SAdV-A1321, SAdV-A1325, SAdV-A1295, SAdV-A1309, SAdV-A1316, or SAdV-A1322 sequences can be utilized in such a method in a manner similar to those described for the human Ad. However, due to the differences in sequences between the SAdV-A1321, SAdV-A1325, SAdV-A1295, SAdV-A1309, SAdV-A1316, or SAdV-A1322 sequences and those of human Ad, the use of the SAdV-A1321, SAdV-A1325, SAdV-A1295, SAdV-A1309, SAdV-A1316, or SAdV-A1322 sequences greatly minimize or eliminate the possibility of homologous recombination with helper functions in a host cell carrying human Ad E1 functions, e.g., 293 cells, which may produce infectious adenoviral contaminants during rAAV production.

Methods of producing rAAV using adenoviral helper functions have been described at length in the literature with human adenoviral serotypes. See, e.g., U.S. Pat. No. 6,258,595 and the references cited therein. See, also, U.S. Pat. No. 5,871,982; WO 99/14354; WO 99/15685; WO 99/47691. These methods may also be used in production of non-human serotype AAV, including non-human primate AAV serotypes. The SAdV-A1321, SAdV-A1325, SAdV-A1295, SAdV-A1309, SAdV-A1316, or SAdV-A1322 sequences which provide the necessary helper functions (e.g., E1a, E1b, E2a, E2b, DNA polymerase and/or E4 ORF6) can be particularly useful in providing the necessary adenoviral function while minimizing or eliminating the possibility of recombination with any other adenoviruses present in the rAAV-packaging cell which are typically of human origin. Thus, selected genes or open reading frames of the SAdV-A1321, SAdV-A1325, SAdV-A1295, SAdV-A1309, SAdV-A1316, or SAdV-A1322 sequences may be utilized in these rAAV production methods.

Alternatively, recombinant SAdV-A1321, SAdV-A1325, SAdV-A1295, SAdV-A1309, SAdV-A1316, or SAdV-A1322 vectors may be utilized in these methods. Such recombinant adenoviral simian vectors may include, e.g., a hybrid chimp Ad/AAV in which chimp Ad sequences flank a rAAV expression cassette composed of, e.g., AAV 3' and/or 5' ITRs and a transgene under the control of regulatory sequences which control its expression. One of skill in the art will recognize that still other simian adenoviral vectors and/or SAdV-A1321, SAdV-A1325, SAdV-A1295, SAdV-A1309, SAdV-A1316, or SAdV-A1322 gene sequences will be useful for production of rAAV and other viruses dependent upon adenoviral helper.

In still another embodiment, nucleic acid molecules are designed for delivery and expression of selected adenoviral gene products in a host cell to achieve a desired physiologic effect. For example, a nucleic acid molecule containing sequences encoding an SAdV-A1321, SAdV-A1325, SAdV-A1295, SAdV-A1309, SAdV-A1316, or SAdV-A1322 E1a protein may be delivered to a subject for use as a cancer therapeutic. Optionally, such a molecule is formulated in a lipid-based carrier and preferentially targets cancer cells. Such a formulation may be combined with other cancer therapeutics (e.g., cisplatin, taxol, or the like). Still other uses for the adenoviral sequences provided herein will be readily apparent to one of skill in the art.

In addition, one of skill in the art will readily understand that the SAdV-A1321, SAdV-A1325, SAdV-A1295, SAdV-A1309, SAdV-A1316, or SAdV-A1322 sequences can be readily adapted for use for a variety of viral and non-viral vector systems for in vitro, ex vivo or in vivo delivery of therapeutic and immunogenic molecules. For example, the SAdV-A1321, SAdV-A1325, SAdV-A1295, SAdV-A1309, SAdV-A1316, or SAdV-A1322 simian Ad sequences can be utilized in a variety of rAd and non-rAd vector systems. Such vectors systems may include, e.g., plasmids, lentiviruses, retroviruses, poxviruses, vaccinia viruses, and adeno-associated viral systems, among others. Selection of these vector systems is not a limitation of the present invention.

The invention further provides molecules useful for production of the simian and simian-derived proteins of the invention. Such molecules which carry polynucleotides including the simian Ad DNA sequences of the invention can be in the form of naked DNA, a plasmid, a virus or any other genetic element.

B. SAdV-A1321, SAdV-A1325, SAdV-A1295, SAdV-A1309, SAdV-A1316, or SAdV-A1322 Adenoviral Proteins Gene products of the SAdV-A1321, SAdV-A1325, SAdV-A1295, SAdV-A1309, SAdV-A1316, or SAdV-A1322 adenovirus, such as proteins, enzymes, and fragments thereof, which are encoded by the adenoviral nucleic acids described herein are provided. Further encompassed are SAdV-A1321, SAdV-A1325, SAdV-A1295, SAdV-A1309, SAdV-A1316, or SAdV-A1322 proteins, enzymes, and fragments thereof, having the amino acid sequences encoded by these nucleic acid sequences which are generated by other methods. Such proteins include those encoded by the open reading frames identified in the table above, the proteins identified in the Tables below with reference to SEQ ID NO, which are provided in the Sequence Listing, and sequences that have substantial homology thereto. Fragments of the proteins and polypeptides identified herein, along with fragments having substantial homology thereto, are also provided.

TABLE 2

PROTEIN SEQUENCES

| Regions | | SAdV-A1321 SEQ ID NO: | SAdV-A1325 SEQ ID NO: | SAdV-A1295 SEQ ID NO: | SAdV-A1309 SEQ ID NO: | SAdV-A1316 SEQ ID NO: | SAdV-A1322 SEQ ID NO: |
|---|---|---|---|---|---|---|---|
| E1a | 13S 12S 9S | 27 | 56 | 85 | 113 | 138 | 167 |
| E1b | Small T/19K | 2 | 29 | 58 | 87 | | 140 |
| | Large T/55K | 21 | 51 | 80 | 108 | 115 | 161 |
| | IX | 3 | 30 | 59 | 88 | 116 | 141 |
| L1 | 52/55D | | 31 | 60 | 89 | 117 | 142 |
| | IIIa | 4 | 32 | 61 | 90 | 118 | 143 |
| L2 | Penton | 5 | 33 | 62 | 91 | 119 | 144 |
| | VII | 6 | 34 | 63 | 92 | 120 | 145 |
| | V | 7 | 35 | 64 | 93 | 121 | 146 |
| | pX | 8 | 36 | 65 | 94 | 122 | 147 |
| L3 | VI | 9 | 37 | 66 | 95 | 123 | 148 |
| | Hexon | 10 | 38 | 67 | 96 | 124 | 149 |
| | Endo-protease | 11 | 39 | 68 | 97 | 125 | 150 |
| L4 | 100 kD | 12 | 40 | 69 | 98 | 126 | 151 |
| | 22 kD | 22 | 52 | 81 | 109 | | 162 |
| | VIII | 13 | 41 | 70 | 99 | 127 | 152 |
| E3 | 12.5k | | 42 | 71 | 100 | | 153 |
| | CR1-alpha | 14 | 53 | 82 | 110 | 128 | 163 |
| | gp19K | 23 | 43 | 72 | 101 | | 154 |
| | CR1-beta | 15 | 44 | 73 | 102 | 129 | 155 |
| | CR1-gamma | 16 | 45 | 74 | 103 | 130 | 156 |
| | CR1-delta | 24 | 46 | 75 | 104 | 131 | 164 |
| | RID-alpha | 17 | 47 | 76 | | 132 | 157 |
| | RID-beta | 18 | 48 | 77 | 105 | 133 | 158 |
| | 14.7K | 25 | 54 | 83 | 111 | 136 | 165 |
| L5 | Fiber | 19 | 49 | 78 | 106 | 134 | 159 |

Thus, in one aspect, unique simian adenoviral proteins which are substantially pure, i.e., are free of other viral and proteinaceous proteins are provided. Preferably, these proteins are at least 10% homogeneous, more preferably 60% homogeneous, and most preferably 95% homogeneous.

In one embodiment, unique simian-derived capsid proteins are provided. As used herein, a simian-derived capsid protein includes any adenoviral capsid protein that contains a SAdV-A1321, SAdV-A1325, SAdV-A1295, SAdV-A1309, SAdV-A1316, or SAdV-A1322 capsid protein or a fragment thereof, as defined above, including, without limitation, chimeric capsid proteins, fusion proteins, artificial capsid proteins, synthetic capsid proteins, and recombinant capsid proteins, without limitation to means of generating these proteins. A capsid as described herein may be entirely of one of SAdV-A1321, SAdV-A1325, SAdV-A1295, SAdV-A1309, SAdV-A1316, or SAdV-A1322, may contain capsid proteins of more than one of SAdV-A1321, SAdV-A1325, SAdV-A1295, SAdV-A1309, SAdV-A1316, or SAdV-A1322, or may contain a capsid protein of another adenovirus.

Suitably, these simian-derived capsid proteins contain one or more SAdV-A1321, SAdV-A1325, SAdV-A1295, SAdV-A1309, SAdV-A1316, or SAdV-A1322 regions or fragments thereof (e.g., a hexon, penton, fiber, or fragment thereof) in combination with capsid regions or fragments thereof of different adenoviral serotypes, or modified simian capsid proteins or fragments, as described herein. A "modification of a capsid protein associated with altered tropism" as used herein includes an altered capsid protein, i.e., a penton, hexon or fiber protein region, or fragment thereof, such as the knob domain of the fiber region, or a polynucleotide encoding same, such that specificity is altered. The simian-derived capsid may be constructed with one or more of the simian Ad of the invention or another Ad serotype which may be of human or non-human origin. Such Ad may be obtained from a variety of sources including the ATCC, commercial and academic sources, or the sequences of the Ad may be obtained from GenBank or other suitable sources.

The amino acid sequences of the penton proteins of SAdV-A1321 [SEQ ID NO: 5], SAdV-A1325 [SEQ ID NO: 33], SAdV-A1295 [SEQ ID NO: 62], SAdV-A1309 [SEQ ID NO: 91], SAdV-A1316 [SEQ ID NO: 119], or SAdV-A1322 [SEQ ID NO: 144], are provided. Suitably, this penton protein, or unique fragments thereof, may be utilized for a variety of purposes. Examples of suitable fragments include the penton having N-terminal and/or C-terminal truncations of about 50, 100, 150, or 200 amino acids, based upon the amino acid numbering provided above and in SEQ ID NO: 5, 33, 62, 91, 119, or 144. Other suitable fragments include shorter internal, C-terminal, or N-terminal fragments. Further, the penton protein may be modified for a variety of purposes known to those of skill in the art.

Also provided is the amino acid sequence of the hexon proteins of SAdV-A1321 [SEQ ID NO: 10], SAdV-A1325 [SEQ ID NO: 38], SAdV-A1295 [SEQ ID NO: 67], SAdV-A1309 [SEQ ID NO: 96], SAdV-A1316 [SEQ ID NO: 124], or SAdV-A1322 [SEQ ID NO: 149]. Suitably, this hexon protein, or unique fragments thereof, may be utilized for a variety of purposes. Examples of suitable fragments include the hexon having N-terminal and/or C-terminal truncations of about 50, 100, 150, 200, 300, 400, or 500 amino acids, based upon the amino acid numbering provided above and in SEQ ID NO: 10, 38, 67, 96, 124, or 149. Other suitable fragments include shorter internal, C-terminal, or N-terminal fragments. For example, one suitable fragment the loop region (domain) of the hexon protein, designated DE1 and FG1, or a hypervariable region thereof. Such fragments include the regions spanning amino acid residues about 125 to 443; about 138 to 441, or smaller fragments, such as those spanning about residue 138 to residue 163; about 170 to about 176; about 195 to about 203; about 233 to about 246; about 253 to about 374; about 287 to about 297; and about 404 to about 430 of the simian hexon proteins, with reference to SEQ ID NO: 10, 38, 67, 96, 124, or 149. Other suitable fragments may be readily identified by one of skill in the art. Further, the hexon protein may be modified for a variety of purposes known to those of skill in the art. Because the hexon protein is the determinant for serotype of an adenovirus, such artificial hexon proteins would result in adenoviruses having artificial serotypes. Other artificial capsid proteins can also be constructed using the chimp Ad penton sequences and/or fiber sequences of the invention and/or fragments thereof.

In one embodiment, an adenovirus having an altered hexon protein utilizing the sequence of the SAdV-A1321, SAdV-A1325, SAdV-A1295, SAdV-A1309, SAdV-A1316, or SAdV-A1322 hexon protein may be generated. One suitable method for altering hexon proteins is described in U.S. Pat. No. 5,922,315, which is incorporated by reference. In this method, at least one loop region of the adenovirus hexon is changed with at least one loop region of another adenovirus serotype. Thus, at least one loop region of such an altered adenovirus hexon protein is a simian Ad hexon loop region of SAdV-A1321, SAdV-A1325, SAdV-A1295, SAdV-A1309, SAdV-A1316, or SAdV-A1322. In one embodiment, a loop region of the SAdV-A1321, SAdV-A1325, SAdV-A1295, SAdV-A1309, SAdV-A1316, or SAdV-A1322 hexon protein is replaced by a loop region from another adenovirus serotype. In another embodiment, the loop region of the SAdV-A1321, SAdV-A1325, SAdV-A1295, SAdV-A1309, SAdV-A1316, or SAdV-A1322 hexon is used to replace a loop region from another adenovirus serotype. Suitable adenovirus serotypes may be readily selected from among human and non-human serotypes, as described herein. The selection of a suitable serotype is not a limitation of the present invention. Still other uses for the SAdV-A1321, SAdV-A1325, SAdV-A1295, SAdV-A1309, SAdV-A1316, or SAdV-A1322 hexon protein sequences will be readily apparent to those of skill in the art.

The amino acid sequence of the fiber protein of SAdV-A1321 [SEQ ID NO: 19], SAdV-A1325 [SEQ ID NO: 49], SAdV-A1295 [SEQ ID NO: 78], SAdV-A1309 [SEQ ID NO: 106], SAdV-A1316 [SEQ ID NO: 134], or SAdV-A1322 [SEQ ID NO: 159] are provided. Suitably, this fiber protein, or unique fragments thereof, may be utilized for a variety of purposes. One suitable fragment is the fiber knob, located within SEQ ID NO: 19, 49, 78, 106, 134, or 159. Examples of other suitable fragments include the fiber having N-terminal and/or C-terminal truncations of about 50, 100, 150, or 200 amino acids, based upon the amino acid numbering provided in SEQ ID NO: 19, 49, 78, 106, 134, or 159. Still other suitable fragments include internal fragments. Further, the fiber protein may be modified using a variety of techniques known to those of skill in the art.

Unique fragments of the proteins of the SAdV-A1321, SAdV-A1325, SAdV-A1295, SAdV-A1309, SAdV-A1316, or SAdV-A1322 are at least 8 amino acids in length. However, fragments of other desired lengths can be readily utilized. In addition, modifications as may be introduced to enhance yield and/or expression of a SAdV-A1321, SAdV-A1325, SAdV-A1295, SAdV-A1309, SAdV-A1316, or SAdV-A1322 gene product, e.g., construction of a fusion molecule in which all or a fragment of the SAdV-A1321, SAdV-A1325, SAdV-A1295, SAdV-A1309, SAdV-A1316, or SAdV-A1322 gene product is fused (either directly or via a linker) with a fusion partner to enhance are provided herein. Other suitable modifications include, without limitation, truncation of a coding region (e.g., a protein or enzyme) to eliminate a pre- or proprotein ordinarily cleaved and to provide the mature protein or enzyme and/or mutation of a coding region to provide a secretable gene product. Still other modifications will be readily apparent to one of skill in the art. Further encompassed are proteins having at least about 98%, about 99%, about 99.5%, or about 99.9 identity to SAdV-A1321, SAdV-A1325, SAdV-A1295, SAdV-A1309, SAdV-A1316, or SAdV-A1322 proteins provided herein.

As described herein, vectors of the invention containing the adenoviral capsid proteins of SAdV-A1321, SAdV-A1325, SAdV-A1295, SAdV-A1309, SAdV-A1316, or SAdV-A1322 are particularly well suited for use in applications in which the neutralizing antibodies diminish the effectiveness of other Ad serotype based vectors, as well as other viral vectors. The rAd vectors are particularly advantageous in readministration for repeat gene therapy or for boosting immune response (vaccine titers).

Under certain circumstances, it may be desirable to use one or more of the SAdV-A1321, SAdV-A1325, SAdV-A1295, SAdV-A1309, SAdV-A1316, or SAdV-A1322 gene products (e.g., a capsid protein or a fragment thereof) to generate an antibody. The term "an antibody," as used herein, refers to an immunoglobulin molecule which is able to specifically bind to an epitope. The antibodies may exist in a variety of forms including, for example, high affinity polyclonal antibodies, monoclonal antibodies, synthetic antibodies, chimeric antibodies, recombinant antibodies and humanized antibodies. Such antibodies originate from immunoglobulin classes IgG, IgM, IgA, IgD and IgE.

Such antibodies may be generated using any of a number of methods know in the art. Suitable antibodies may be generated by well-known conventional techniques, e.g., Kohler and Milstein and the many known modifications thereof. Similarly desirable high titer antibodies are generated by applying known recombinant techniques to the monoclonal or polyclonal antibodies developed to these antigens [see, e.g., PCT Patent Application No. PCT/GB85/00392; British Patent Application Publication No. GB2188638A; Amit et al., 1986 *Science*, 233:747-753; Queen et al., 1989 *Proc. Nat'l. Acad. Sci. USA*, 86:10029-10033; PCT Patent Application No. PCT/WO9007861; and Riechmann et al., *Nature*, 332:323-327 (1988); Huse et al, 1988a *Science*, 246:1275-1281]. Alternatively, antibodies can be produced by manipulating the complementarity determining regions of animal or human antibodies to the antigen of this invention. See, e.g., E. Mark and Padlin, "Humanization of Monoclonal Antibodies", Chapter 4, The Handbook of Experimental Pharmacology, Vol. 113, The Pharmacology of Monoclonal Antibodies, Springer-Verlag (June, 1994); Harlow et al., 1999, Using Antibodies: A Laboratory Manual, Cold Spring Harbor Laboratory Press, NY; Harlow et al., 1989, Antibodies: A Laboratory Manual, Cold Spring Harbor, N.Y.; Houston et al., 1988, *Proc. Natl. Acad. Sci. USA* 85:5879-5883; and Bird et al., 1988, *Science* 242:423-437. Further provided by the present invention are anti-idiotype antibodies (Ab2) and anti-anti-idiotype antibodies (Ab3). See, e.g., M. Wettendorff et al., "Modulation of anti-tumor immunity by anti-idiotypic antibodies." In Idiotypic Network and Diseases, ed. by J. Cerny and J. Hiernaux, 1990 *J. Am. Soc. Microbiol.*, Washington D.C.: pp. 203-229]. These anti-idiotype and anti-anti-idiotype antibodies are produced using techniques well known to those of skill in the art. These antibodies may be used for a variety of purposes, including diagnostic and clinical methods and kits.

Under certain circumstances, it may be desirable to introduce a detectable label or a tag onto a SAdV-A1321, SAdV-A1325, SAdV-A1295, SAdV-A1309, SAdV-A1316, or SAdV-A1322 gene product, antibody or other construct of the invention. As used herein, a detectable label is a molecule which is capable, alone or upon interaction with another molecule, of providing a detectable signal. Most desirably, the label is detectable visually, e.g. by fluorescence, for ready use in immunohistochemical analyses or immunofluorescent microscopy. For example, suitable labels include fluorescein isothiocyanate (FITC), phycoerythrin (PE), allophycocyanin (APC), coriphosphine-O(CPO) or tandem dyes, PE-cyanin-5 (PC5), and PE-Texas Red (ECD). All of these fluorescent dyes are commercially available, and their uses known to the art. Other useful labels include a colloidal gold label. Still other useful labels include radioactive compounds or elements. Additionally, labels include a variety of enzyme systems that operate to reveal a colorimetric signal in an assay, e.g., glucose oxidase (which uses glucose as a substrate) releases peroxide as a product which in the presence of peroxidase and a hydrogen donor such as tetramethyl benzidine (TMB) produces an oxidized TMB that is seen as a blue color. Other examples include horseradish peroxidase (HRP), alkaline phosphatase (AP), and hexokinase in conjunction with glucose-6-phosphate dehydrogenase which reacts with ATP, glucose, and NAD+ to yield, among other products, NADH that is detected as increased absorbance at 340 nm wavelength.

Other label systems that are utilized in the methods described herein are detectable by other means, e.g., colored latex microparticles [Bangs Laboratories, Indiana] in which a dye is embedded are used in place of enzymes to form conjugates with the target sequences to provide a visual signal indicative of the presence of the resulting complex in applicable assays.

Methods for coupling or associating the label with a desired molecule are similarly conventional and known to those of skill in the art. Known methods of label attachment are described [see, for example, Handbook of Fluorescent probes and Research Chemicals, 6th Ed., R. P. M. Haugland, Molecular Probes, Inc., Eugene, Oreg., 1996; Pierce Catalog and Handbook, Life Science and Analytical Research Products, Pierce Chemical Company, Rockford, Ill., 1994/1995]. Thus, selection of the label and coupling methods do not limit this invention.

The sequences, proteins, and fragments of SAdV-A1321, SAdV-A1325, SAdV-A1295, SAdV-A1309, SAdV-A1316, or SAdV-A1322 may be produced by any suitable means, including recombinant production, chemical synthesis, or other synthetic means. Suitable production techniques are well known to those of skill in the art. See, e.g., Sambrook et al, Molecular Cloning: A Laboratory Manual, Cold Spring Harbor Press (Cold Spring Harbor, N.Y.). Alternatively, peptides can also be synthesized by the well known solid phase peptide synthesis methods (Merrifield, *J. Am. Chem. Soc.*, 85:2149 (1962); Stewart and Young, Solid Phase Peptide Synthesis (Freeman, San Francisco, 1969) pp. 27-62). These and other suitable production methods are within the knowledge of those of skill in the art and are not a limitation of the present invention.

In addition, one of skill in the art will readily understand that the SAdV-A1321, SAdV-A1325, SAdV-A1295, SAdV-A1309, SAdV-A1316, or SAdV-A1322 sequences can be readily adapted for use for a variety of viral and non-viral vector systems for in vitro, ex vivo or in vivo delivery of therapeutic and immunogenic molecules. For example, in one embodiment, the simian Ad capsid proteins and other simian adenovirus proteins described herein are used for non-viral, protein-based delivery of genes, proteins, and other desirable diagnostic, therapeutic and immunogenic molecules. In one such embodiment, a protein of the invention is linked, directly or indirectly, to a molecule for targeting to cells with a receptor for adenoviruses. Preferably, a capsid protein such as a hexon, penton, fiber or a fragment thereof having a ligand for a cell surface receptor is selected for such targeting. Suitable molecules for delivery are selected from among the therapeutic molecules described herein and their gene products. A variety of linkers including, lipids, polyLys, and the like may be utilized as linkers. For example, the simian penton protein may be readily utilized for such a purpose by production of a fusion protein using the simian penton sequences in a manner analogous to that described in Medina-Kauwe L K, et al, *Gene Ther.* 2001 May; 8(10):795-803 and Medina-Kauwe L K, et al, *Gene Ther.* 2001 December; 8(23): 1753-1761. Alternatively, the amino acid sequences of simian Ad protein IX may be utilized for targeting vectors to a cell surface receptor, as described in US Patent Appln 20010047081. Suitable ligands include a CD40 antigen, an RGD-containing or polylysine-containing sequence, and the like. Still other simian Ad proteins, including, e.g., the hexon protein and/or the fiber protein, may be used for used for these and similar purposes.

Still other SAdV-A1321, SAdV-A1325, SAdV-A1295, SAdV-A1309, SAdV-A1316, or SAdV-A1322 adenoviral proteins may be used as alone, or in combination with other adenoviral protein, for a variety of purposes which will be readily apparent to one of skill in the art. In addition, still other uses for the SAdV adenoviral proteins will be readily apparent to one of skill in the art.

II. Recombinant Adenoviral Vectors

The compositions described herein include vectors that deliver a heterologous molecule to cells, either for therapeutic or vaccine purposes. As used herein, a vector may include any genetic element including, without limitation, naked DNA, a phage, transposon, cosmid, episome, plasmid, or a virus. Such vectors contain simian adenovirus DNA of SAdV-A1321, SAdV-A1325, SAdV-A1295, SAdV-A1309, SAdV-A1316, or SAdV-A1322 and a minigene. By "minigene" or "expression cassette" is meant the combination of a selected heterologous gene and the other regulatory elements necessary to drive translation, transcription and/or expression of the gene product in a host cell.

Typically, a SAdV-A1321-, SAdV-A1325-, SAdV-A1295-, SAdV-A1309-, SAdV-A1316-, or SAdV-A1322-derived adenoviral vector is designed such that the minigene is located in a nucleic acid molecule which contains other adenoviral sequences in the region native to a selected adenoviral gene. The minigene may be inserted into an existing gene region to disrupt the function of that region, if desired. Alternatively, the minigene may be inserted into the site of a partially or fully deleted adenoviral gene. For example, the minigene may be located in the site of such as the site of a functional E1 deletion or functional E3 deletion, among others that may be selected. The term "functionally deleted" or "functional deletion" means that a sufficient amount of the gene region is removed or otherwise damaged, e.g., by mutation or modification, so that the gene region is no longer capable of producing functional products of gene expression. If desired, the entire gene region may be removed. Other suitable sites for gene disruption or deletion are discussed elsewhere in the application.

For example, for a production vector useful for generation of a recombinant virus, the vector may contain the minigene and either the 5' end of the adenoviral genome or the 3' end of the adenoviral genome, or both the 5' and 3' ends of the adenoviral genome. The 5' end of the adenoviral genome contains the 5' cis-elements necessary for packaging and replication; i.e., the 5' inverted terminal repeat (ITR) sequences (which function as origins of replication) and the native 5' packaging enhancer domains (that contain sequences necessary for packaging linear Ad genomes and enhancer elements for the E1 promoter). The 3' end of the adenoviral genome includes the 3' cis-elements (including the ITRs) necessary for packaging and encapsidation. Suitably, a recombinant adenovirus contains both 5' and 3' adenoviral cis-elements and the minigene is located between the 5' and 3' adenoviral sequences. A SAdV-A1321-, SAdV-A1325-, SAdV-A1295-, SAdV-A1309-, SAdV-A1316-, or SAdV-A1322-based adenoviral vector may also contain additional adenoviral sequences.

Suitably, these SAdV-A1321-, SAdV-A1325-, SAdV-A1295-, SAdV-A1309-, SAdV-A1316-, or SAdV-A1322-based adenoviral vectors contain one or more adenoviral elements derived from the adenoviral genome of the invention. In one embodiment, the vectors contain adenoviral ITRs from SAdV-A1321, SAdV-A1325, SAdV-A1295, SAdV-A1309, SAdV-A1316, or SAdV-A1322 and additional adenoviral sequences from the same adenoviral serotype. In another embodiment, the vectors contain adenoviral sequences that are derived from a different adenoviral serotype than that which provides the ITRs.

As defined herein, a pseudotyped adenovirus refers to an adenovirus in which the capsid protein of the adenovirus is from a different adenovirus than the adenovirus which provides the ITRs.

Further, chimeric or hybrid adenoviruses may be constructed using the adenoviruses described herein using techniques known to those of skill in the art. See, e.g., U.S. Pat. No. 7,291,498.

The selection of the adenoviral source of the ITRs and the source of any other adenoviral sequences present in vector is not a limitation of the present embodiment. A variety of adenovirus strains are available from the American Type Culture Collection, Manassas, Va., or available by request from a variety of commercial and institutional sources. Further, the sequences of many such strains are available from a variety of databases including, e.g., PubMed and GenBank. Homologous adenovirus vectors prepared from other simian or from human adenoviruses are described in the published literature [see, for example, U.S. Pat. No. 5,240,846]. The DNA sequences of a number of adenovirus types are available from GenBank, including type Ad5 [GenBank Accession No. M73370]. The adenovirus sequences may be obtained from any known adenovirus serotype, such as serotypes 2, 3, 4, 7, 12 and 40, and further including any of the presently identified human types. Similarly adenoviruses known to infect non-human animals (e.g., simians) may also be employed in the vector constructs of this invention. See, e.g., U.S. Pat. No. 6,083,716.

The viral sequences, helper viruses (if needed), and recombinant viral particles, and other vector components and sequences employed in the construction of the vectors described herein are obtained as described above. The DNA sequences of the SAdV-A1321, SAdV-A1325, SAdV-A1295, SAdV-A1309, SAdV-A1316, or SAdV-A1322 simian adenovirus of the invention are employed to construct vectors and cell lines useful in the preparation of such vectors.

Modifications of the nucleic acid sequences forming the vectors of this invention, including sequence deletions, insertions, and other mutations may be generated using standard molecular biological techniques and are within the scope of this embodiment.

A. The "Minigene"

The methods employed for the selection of the transgene, the cloning and construction of the "minigene" and its insertion into the viral vector are within the skill in the art given the teachings provided herein.

1. The Transgene

The transgene is a nucleic acid sequence, heterologous to the vector sequences flanking the transgene, which encodes a polypeptide, protein, or other product, of interest. The nucleic acid coding sequence is operatively linked to regulatory components in a manner which permits transgene transcription, translation, and/or expression in a host cell.

The composition of the transgene sequence will depend upon the use to which the resulting vector will be put. For example, one type of transgene sequence includes a reporter sequence, which upon expression produces a detectable signal. Such reporter sequences include, without limitation, DNA sequences encoding β-lactamase, β-galactosidase (LacZ), alkaline phosphatase, thymidine kinase, green fluorescent protein (GFP), chloramphenicol acetyltransferase (CAT), luciferase, membrane bound proteins including, for example, CD2, CD4, CD8, the influenza hemagglutinin protein, and others well known in the art, to which high affinity antibodies directed thereto exist or can be produced by conventional means, and fusion proteins comprising a membrane bound protein appropriately fused to an antigen tag domain from, among others, hemagglutinin or Myc. These coding sequences, when associated with regulatory elements which drive their expression, provide signals detectable by conventional means, including enzymatic, radiographic, colorimetric, fluorescence or other spectrographic assays, fluorescent activating cell sorting assays and immunological assays, including enzyme linked immunosorbent assay (ELISA), radioimmunoassay (RIA) and immunohistochemistry. For example, where the marker sequence is the LacZ gene, the presence of the vector carrying the signal is detected by assays for beta-galactosidase activity. Where the transgene is GFP or luciferase, the vector carrying the signal may be measured visually by color or light production in a luminometer.

In one embodiment, the transgene is a non-marker sequence encoding a product which is useful in biology and medicine, such as proteins, peptides, RNA, enzymes, or catalytic RNAs. Desirable RNA molecules include tRNA, dsRNA, ribosomal RNA, catalytic RNAs, and antisense RNAs. One example of a useful RNA sequence is a sequence which extinguishes expression of a targeted nucleic acid sequence in the treated animal.

The transgene may be used for treatment, e.g., of genetic deficiencies, as a cancer therapeutic or vaccine, for induction of an immune response, and/or for prophylactic vaccine purposes. As used herein, induction of an immune response refers to the ability of a molecule (e.g., a gene product) to induce a T cell and/or a humoral immune response to the molecule. The invention further includes using multiple transgenes, e.g., to correct or ameliorate a condition caused by a multi-subunit protein. In certain situations, a different transgene may be used to encode each subunit of a protein, or to encode different peptides or proteins. This is desirable when the size of the DNA encoding the protein subunit is large, e.g., for an immunoglobulin, the platelet-derived growth factor, or a dystrophin protein. In order for the cell to produce the multi-subunit protein, a cell is infected with the recombinant virus containing each of the different subunits. Alternatively, different subunits of a protein may be encoded by the same transgene. In this case, a single transgene includes the DNA encoding each of the subunits, with the DNA for each subunit separated by an internal ribozyme entry site (IRES). This is desirable when the size of the DNA encoding each of the subunits is small, e.g., the total size of the DNA encoding the subunits and the IRES is less than five kilobases. As an alternative to an IRES, the DNA may be separated by sequences encoding a 2A peptide, which self-cleaves in a post-translational event. See, e.g., M. L. Donnelly, et al, *J. Gen. Virol.*, 78(Pt 1):13-21 (January 1997); Furler, S., et al, *Gene Ther.*, 8(11):864-873 (June 2001);

Klump H., et al., *Gene Ther.*, 8(10):811-817 (May 2001). This 2A peptide is significantly smaller than an IRES, making it well suited for use when space is a limiting factor. However, the selected transgene may encode any biologically active product or other product, e.g., a product desirable for study.

Suitable transgenes may be readily selected by one of skill in the art. The selection of the transgene is not considered to be a limitation of this embodiment.

2. Regulatory Elements

In addition to the major elements identified above for the minigene, the vector also includes conventional control elements necessary which are operably linked to the transgene in a manner that permits its transcription, translation and/or expression in a cell transfected with the plasmid vector or infected with the virus produced by the invention. As used herein, "operably linked" sequences include both expression control sequences that are contiguous with the gene of interest and expression control sequences that act in trans or at a distance to control the gene of interest.

Expression control sequences include appropriate transcription initiation, termination, promoter and enhancer sequences; efficient RNA processing signals such as splicing and polyadenylation (polyA) signals including rabbit beta-globin polyA; sequences that stabilize cytoplasmic mRNA; sequences that enhance translation efficiency (e.g., Kozak consensus sequence); sequences that enhance protein stability; and when desired, sequences that enhance secretion of the encoded product. Among other sequences, chimeric introns may be used.

A great number of expression control sequences, including promoters which are native, constitutive, inducible and/or tissue-specific, are known in the art and may be utilized. Examples of constitutive promoters include, without limitation, the TBG promoter, the retroviral Rous sarcoma virus (RSV) LTR promoter (optionally with the RSV enhancer), the cytomegalovirus (CMV) promoter (optionally with the CMV enhancer) [see, e.g., Boshart et al, *Cell*, 41:521-530 (1985)], the SV40 promoter, the dihydrofolate reductase promoter, the β-actin promoter, the phosphoglycerol kinase (PGK) promoter, and the EFla promoter [Invitrogen].

Inducible promoters allow regulation of gene expression and can be regulated by exogenously supplied compounds, environmental factors such as temperature, or the presence of a specific physiological state, e.g., acute phase, a particular differentiation state of the cell, or in replicating cells only. Inducible promoters and inducible systems are available from a variety of commercial sources, including, without limitation, Invitrogen, Clontech and Ariad. Many other systems have been described and can be readily selected by one of skill in the art. For example, inducible promoters include the zinc-inducible sheep metallothionine (MT) promoter and the dexamethasone (Dex)-inducible mouse mammary tumor virus (MMTV) promoter. Other inducible systems include the T7 polymerase promoter system [WO 98/10088]; the ecdysone insect promoter [No et al, *Proc. Natl. Acad. Sci. USA*, 93:3346-3351 (1996)], the tetracycline-repressible system [Gossen et al, *Proc. Natl. Acad. Sci. USA*, 89:5547-5551 (1992)], the tetracycline-inducible system [Gossen et al, *Science*, 378:1766-1769 (1995), see also Harvey et al, *Curr. Opin. Chem. Biol.*, 2:512-518 (1998)]. Other systems include the FK506 dimer, VP16 or p65 using castradiol, diphenol murislerone, the RU486-inducible system [Wang et al, *Nat. Biotech.*, 15:239-243 (1997) and Wang et al, *Gene Ther.*, 4:432-441 (1997)] and the rapamycin-inducible system [Magari et al, *J. Clin. Invest.*, 100:2865-2872 (1997)]. The effectiveness of some inducible promoters increases over time. In such cases one can enhance the effectiveness of such systems by inserting multiple repressors in tandem, e.g., TetR linked to a TetR by an IRES. Alternatively, one can wait at least 3 days before screening for the desired function. One can enhance expression of desired proteins by known means to enhance the effectiveness of this system. For example, using the Woodchuck Hepatitis Virus Posttranscriptional Regulatory Element (WPRE).

In another embodiment, the native promoter for the transgene will be used. The native promoter may be preferred when it is desired that expression of the transgene should mimic the native expression. The native promoter may be used when expression of the transgene must be regulated temporally or developmentally, or in a tissue-specific manner, or in response to specific transcriptional stimuli. In a further embodiment, other native expression control elements, such as enhancer elements, polyadenylation sites or Kozak consensus sequences may also be used to mimic the native expression.

Another embodiment of the transgene includes a transgene operably linked to a tissue-specific promoter. For instance, if expression in skeletal muscle is desired, a promoter active in muscle should be used. These include the promoters from genes encoding skeletal β-actin, myosin light chain 2A, dystrophin, muscle creatine kinase, as well as synthetic muscle promoters with activities higher than naturally occurring promoters (see Li et al., *Nat. Biotech.*, 17:241-245 (1999)). Examples of promoters that are tissue-specific are known for liver (albumin, Miyatake et al., *J. Virol.*, 71:5124-32 (1997); hepatitis B virus core promoter, Sandig et al., *Gene Ther.*, 3:1002-9 (1996); alpha-fetoprotein (AFP), Arbuthnot et al., *Hum. Gene Ther.*, 7:1503-14 (1996)), bone osteocalcin (Stein et al., *Mol. Biol. Rep.*, 24:185-96 (1997)); bone sialoprotein (Chen et al., *J. Bone Miner. Res.*, 11:654-64 (1996)), lymphocytes (CD2, Hansal et al., *J. Immunol.*, 161:1063-8 (1998); immunoglobulin heavy chain; T cell receptor chain), neuronal such as neuron-specific enolase (NSE) promoter (Andersen et al., *Cell. Mol. Neurobiol.*, 13:503-15 (1993)), neurofilament light-chain gene (Piccioli et al., *Proc. Natl. Acad. Sci. USA*, 88:5611-5 (1991)), and the neuron-specific vgf gene (Piccioli et al., *Neuron*, 15:373-84 (1995)), among others.

Optionally, vectors carrying transgenes encoding therapeutically useful or immunogenic products may also include selectable markers or reporter genes may include sequences encoding geneticin, hygromicin or purimycin resistance, among others. Such selectable reporters or marker genes (preferably located outside the viral genome to be packaged into a viral particle) can be used to signal the presence of the plasmids in bacterial cells, such as ampicillin resistance. Other components of the vector may include an origin of replication. Selection of these and other promoters and vector elements are conventional and many such sequences are available [see, e.g., Sambrook et al, and references cited therein].

These vectors are generated using the techniques and sequences provided herein, in conjunction with techniques known to those of skill in the art. Such techniques include conventional cloning techniques of cDNA such as those described in texts [Sambrook et al, Molecular Cloning: A Laboratory Manual, Cold Spring Harbor Press, Cold Spring Harbor, N.Y.], use of overlapping oligonucleotide sequences of the adenovirus genomes, polymerase chain reaction, and any suitable method which provides the desired nucleotide sequence.

III. Production of the Viral Vector

In one embodiment, the simian adenoviral plasmids (or other vectors) are used to produce adenoviral vectors. In one embodiment, the adenoviral vectors are adenoviral particles which are replication—defective. In one embodiment, the adenoviral particles are rendered replication-defective by deletions in the E1a and/or E1b genes. Alternatively, the adenoviruses are rendered replication-defective by another means, optionally while retaining the E1a and/or E1b genes. Similarly, in some embodiments, reduction of an immune response to the vector may be accomplished by deletions in the E2b and/or DNA polymerase genes. The adenoviral vectors can also contain other mutations to the adenoviral genome, e.g., temperature-sensitive mutations or deletions in other genes. In other embodiments, it is desirable to retain an intact E1a and/or E1b region in the adenoviral vectors. Such an intact E1 region may be located in its native location in the adenoviral genome or placed in the site of a deletion in the native adenoviral genome (e.g., in the E3 region).

In the construction of useful simian adenovirus vectors for delivery of a gene to the human (or other mammalian) cell, a range of adenovirus nucleic acid sequences can be employed in the vectors. For example, all or a portion of the adenovirus delayed early gene E3 may be eliminated from the simian adenovirus sequence which forms a part of the recombinant virus. The function of simian E3 is believed to be irrelevant to the function and production of the recombinant virus particle. Simian adenovirus vectors may also be constructed having a deletion of at least the ORF6 region of the E4 gene, and more desirably because of the redundancy in the function of this region, the entire E4 region. Still another vector of this invention contains a deletion in the delayed early gene E2a. Deletions may also be made in any of the late genes L1 through L5 of the simian adenovirus genome. Similarly, deletions in the intermediate genes IX and IVa$_2$ may be useful for some purposes. Other deletions may be made in the other structural or non-structural adenovirus genes. The above discussed deletions may be used individually, i.e., an adenovirus sequence for use as described herein may contain deletions in only a single region. Alternatively, deletions of entire genes or portions thereof effective to destroy their biological activity may be used in any combination. For example, in one exemplary vector, the adenovirus sequence may have deletions of the E1 genes and the E4 gene, or of the E1, E2a and E3 genes, or of the E1 and E3 genes, or of E1, E2a and E4 genes, with or without deletion of E3, and so on. As discussed above, such deletions may be used in combination with other mutations, such as temperature-sensitive mutations, to achieve a desired result.

An adenoviral vector lacking any essential adenoviral sequences (e.g., E1a, E1b, E2a, E2b, E4 ORF6, L1, L2, L3, L4 and L5) may be cultured in the presence of the missing adenoviral gene products which are required for viral infectivity and propagation of an adenoviral particle. These helper functions may be provided by culturing the adenoviral vector in the presence of one or more helper constructs (e.g., a plasmid or virus) or a packaging host cell. See, for example, the techniques described for preparation of a "minimal" human Ad vector in International Patent Application WO96/13597, published May 9, 1996, and incorporated herein by reference.

1. Helper Viruses

Thus, depending upon the simian adenovirus gene content of the viral vectors employed to carry the minigene, a helper adenovirus or non-replicating virus fragment may be necessary to provide sufficient simian adenovirus gene sequences necessary to produce an infective recombinant viral particle containing the minigene. Useful helper viruses contain selected adenovirus gene sequences not present in the adenovirus vector construct and/or not expressed by the packaging cell line in which the vector is transfected. In one embodiment, the helper virus is replication-defective and contains a variety of adenovirus genes in addition to the sequences described above. Such a helper virus is desirably used in combination with an E1-expressing cell line.

Helper viruses may also be formed into poly-cation conjugates as described in Wu et al, *J. Biol. Chem.*, 374:16985-16987 (1989); K. J. Fisher and J. M. Wilson, *Biochem. J.*, 299:49 (Apr. 1, 1994). Helper virus may optionally contain a second reporter minigene. A number of such reporter genes are known to the art. The presence of a reporter gene on the helper virus which is different from the transgene on the adenovirus vector allows both the Ad vector and the helper virus to be independently monitored. This second reporter is used to enable separation between the resulting recombinant virus and the helper virus upon purification.

2. Complementation Cell Lines

To generate recombinant simian adenoviruses (Ad) deleted in any of the genes described above, the function of the deleted gene region, if essential to the replication and infectivity of the virus, must be supplied to the recombinant virus by a helper virus or cell line, i.e., a complementation or packaging cell line. In many circumstances, a cell line expressing the human E1 can be used to transcomplement the chimp Ad vector. This is particularly advantageous because, due to the diversity between the chimp Ad sequences of the invention and the human AdE1 sequences found in currently available packaging cells, the use of the current human E1-containing cells prevents the generation of replication-competent adenoviruses during the replication and production process. However, in certain circumstances, it will be desirable to utilize a cell line which expresses the E1 gene products that can be utilized for production of an E1-deleted simian adenovirus. Such cell lines have been described. See, e.g., U.S. Pat. No. 6,083,716.

If desired, one may utilize the sequences provided herein to generate a packaging cell or cell line that expresses, at a minimum, the adenovirus E1 gene from SAdV-A1321, SAdV-A1325, SAdV-A1295, SAdV-A1309, SAdV-A1316, or SAdV-A1322 under the transcriptional control of a promoter for expression in a selected parent cell line. Inducible or constitutive promoters may be employed for this purpose. Examples of such promoters are described in detail elsewhere in this specification. A parent cell is selected for the generation of a novel cell line expressing any desired SAdV-A1321, SAdV-A1325, SAdV-A1295, SAdV-A1309, SAdV-A1316, or SAdV-A1322 gene. Without limitation, such a parent cell line may be HeLa [ATCC Accession No. CCL 2], A549 [ATCC Accession No. CCL 185], HEK 293, KB [CCL 17], Detroit [e.g., Detroit 510, CCL 72] and WI-38 [CCL 75] cells, among others. These cell lines are all available from the American Type Culture Collection, 10801 University Boulevard, Manassas, Va. 20110-2209. Other suitable parent cell lines may be obtained from other sources.

Such E1-expressing cell lines are useful in the generation of recombinant simian adenovirus E1 deleted vectors. Additionally, or alternatively, cell lines that express one or more simian adenoviral gene products, e.g., E1a, E1b, E2a, and/or E4 ORF6, can be constructed using essentially the same procedures are used in the generation of recombinant simian viral vectors. Such cell lines can be utilized to transcomplement adenovirus vectors deleted in the essential genes that encode those products, or to provide helper functions necessary for packaging of a helper-dependent virus (e.g., adeno-associated virus). The preparation of a host cell involves techniques such as assembly of selected DNA sequences. This assembly may be accomplished utilizing conventional techniques. Such techniques include cDNA and genomic cloning, which are well known and are described in Sambrook et al., cited above, use of overlapping oligonucleotide sequences of the adenovirus genomes, combined with polymerase chain reaction, synthetic methods, and any other suitable methods which provide the desired nucleotide sequence.

In still another alternative, the essential adenoviral gene products are provided in trans by the adenoviral vector and/or helper virus. In such an instance, a suitable host cell can be selected from any biological organism, including prokaryotic (e.g., bacterial) cells, and eukaryotic cells, including, insect cells, yeast cells and mammalian cells. Particularly desirable host cells are selected from among any mammalian species, including, without limitation, cells such as A549, WEHI, 3T3, 10T1/2, HEK 293 cells or PERC6 (both of which express functional adenoviral E1) [Fallaux, F J et al, (1998), Hum Gene Ther, 9:1909-1917], Saos, C2C12, L cells, HT1080, HepG2 and primary fibroblast, hepatocyte and myoblast cells derived from mammals including human, monkey, mouse, rat, rabbit, and hamster. The selection of the mammalian species providing the cells is not a limitation of this invention; nor is the type of mammalian cell, i.e., fibroblast, hepatocyte, tumor cell, etc.

3. Assembly of Viral Particle and Transfection of a Cell Line

Generally, when delivering the vector comprising the minigene by transfection, the vector is delivered in an amount from about 5 µg to about 100 µg DNA, and preferably about 10 to about 50 µg DNA to about $1 \times 10^4$ cells to about $1 \times 10^{13}$ cells, and preferably about $10^5$ cells. However, the relative amounts of vector DNA to host cells may be adjusted, taking into consideration such factors as the selected vector, the delivery method and the host cells selected.

The vector may be any vector known in the art or disclosed above, including naked DNA, a plasmid, phage, transposon, cosmids, episomes, viruses, etc. Introduction into the host cell of the vector may be achieved by any means known in the art or as disclosed above, including transfection, and infection. One or more of the adenoviral genes may be stably integrated into the genome of the host cell, stably expressed as episomes, or expressed transiently. The gene products may all be expressed transiently, on an episome or stably integrated, or some of the gene products may be expressed stably while others are expressed transiently. Furthermore, the promoters for each of the adenoviral genes may be selected independently from a constitutive promoter, an inducible promoter or a native adenoviral promoter. The promoters may be regulated by a specific physiological state of the organism or cell (i.e., by the differentiation state or in replicating or quiescent cells) or by exogenously-added factors, for example.

Introduction of the molecules (as plasmids or viruses) into the host cell may also be accomplished using techniques known to the skilled artisan and as discussed throughout the specification. In preferred embodiment, standard transfection techniques are used, e.g., $CaPO_4$ transfection or electroporation.

Assembly of the selected DNA sequences of the adenovirus (as well as the transgene and other vector elements into various intermediate plasmids, and the use of the plasmids and vectors to produce a recombinant viral particle are all achieved using conventional techniques. Such techniques include conventional cloning techniques of cDNA such as those described in texts [Sambrook et al, cited above], use of overlapping oligonucleotide sequences of the adenovirus genomes, polymerase chain reaction, and any suitable method which provides the desired nucleotide sequence. Standard transfection and co-transfection techniques are employed, e.g., $CaPO_4$ precipitation techniques. Other conventional methods employed include homologous recombination of the viral genomes, plaquing of viruses in agar overlay, methods of measuring signal generation, and the like.

For example, following the construction and assembly of the desired minigene-containing viral vector, the vector is transfected in vitro in the presence of a helper virus into the packaging cell line. Homologous recombination occurs between the helper and the vector sequences, which permits the adenovirus-transgene sequences in the vector to be replicated and packaged into virion capsids, resulting in the recombinant viral vector particles. The current method for producing such virus particles is transfection-based. However, the invention is not limited to such methods.

The resulting recombinant simian adenoviruses are useful in transferring a selected transgene to a selected cell. In in vivo experiments with the recombinant virus grown in the packaging cell lines, the E1-deleted recombinant simian adenoviral vectors of the invention demonstrate utility in transferring a transgene to a non-simian, preferably a human, cell.

IV. Use of the Recombinant Adenovirus Vectors

The recombinant simian adenovirus A1321 (SAdV-A1321)-, SAdV-A1325-, SAdV-A1295-, SAdV-A1309-, SAdV-A1316-, or SAdV-A1322-based vectors are useful for gene transfer to a human or non-simian veterinary patient in vitro, ex vivo, and in vivo.

The recombinant adenovirus vectors described herein can be used as expression vectors for the production of the products encoded by the heterologous genes in vitro. For example, the recombinant adenoviruses containing a gene inserted into the location of an E1 deletion may be transfected into an E1-expressing cell line as described above. Alternatively, replication-competent adenoviruses may be used in another selected cell line. The transfected cells are then cultured in the conventional manner, allowing the recombinant adenovirus to express the gene product from the promoter. The gene product may then be recovered from the culture medium by known conventional methods of protein isolation and recovery from culture.

A SAdV-A1321-, SAdV-A1325-, SAdV-A1295-, SAdV-A1309-, SAdV-A1316-, or SAdV-A1322-derived recombinant simian adenoviral vector provides an efficient gene transfer vehicle that can deliver a selected transgene to a selected host cell in vivo or ex vivo even where the organism has neutralizing antibodies to one or more AAV serotypes. In one embodiment, the rAAV and the cells are mixed ex vivo; the infected cells are cultured using conventional methodologies; and the transduced cells are re-infused into the patient. These compositions are particularly well suited to gene delivery for therapeutic purposes and for immunization, including inducing protective immunity.

More commonly, the SAdV-A1321, SAdV-A1325, SAdV-A1295, SAdV-A1309, SAdV-A1316, or SAdV-A1322 recombinant adenoviral vectors will be utilized for delivery of therapeutic or immunogenic molecules, as described below. It will be readily understood for both applications, that the recombinant adenoviral vectors of the invention are particularly well suited for use in regimens involving repeat delivery of recombinant adenoviral vectors. Such regimens typically involve delivery of a series of viral vectors in which the viral capsids are alternated. The viral capsids may be changed for each subsequent administration, or after a preselected number of administrations of a particular serotype capsid (e.g., one, two, three, four or more). Thus, a regimen may involve delivery of a rAd with a first simian capsid, delivery with a rAd with a second simian capsid, and delivery with a third simian capsid. A variety of other regimens which use the Ad capsids of the invention alone, in combination with one another, or in combination with other adenoviruses (which are preferably immunologically non-crossreactive) will be apparent to those of skill in the art. Optionally, such a regimen may involve administration of rAd with capsids of other non-human primate adenoviruses, human adenoviruses, or artificial sequences such as are described herein. Each phase of the regimen may involve administration of a series of injections (or other delivery routes) with a single Ad capsid followed by a series with another capsid from a different Ad source. Alternatively, the SAdV-A1321, SAdV-A1325, SAdV-A1295, SAdV-A1309, SAdV-A1316, or SAdV-A1322 vectors may be utilized in regimens involving other non-adenoviral-mediated delivery systems, including other viral systems, non-viral delivery systems, protein, peptides, and other biologically active molecules.

The following sections will focus on exemplary molecules which may be delivered via the adenoviral vectors of the invention.

A. Ad-Mediated Delivery of Therapeutic Molecules

In one embodiment, the above-described recombinant vectors are administered to humans according to published methods for gene therapy. A simian adenoviral vector bearing the selected transgene may be administered to a patient, preferably suspended in a biologically compatible solution or pharmaceutically acceptable delivery vehicle. A suitable vehicle includes sterile saline. Other aqueous and non-aqueous isotonic sterile injection solutions and aqueous and non-aqueous sterile suspensions known to be pharmaceutically acceptable carriers and well known to those of skill in the art may be employed for this purpose.

The simian adenoviral vectors are administered in sufficient amounts to transduce the target cells and to provide sufficient levels of gene transfer and expression to provide a therapeutic benefit without undue adverse or with medically acceptable physiological effects, which can be determined by those skilled in the medical arts. Conventional and pharmaceutically acceptable routes of administration include, but are not limited to, direct delivery to the retina and other intraocular delivery methods, direct delivery to the liver, inhalation, intranasal, intravenous, intramuscular, intratracheal, subcutaneous, intradermal, rectal, oral and other parenteral routes of administration. Routes of administration may be combined, if desired, or adjusted depending upon the transgene or the condition. The route of administration primarily will depend on the nature of the condition being treated.

Dosages of the viral vector will depend primarily on factors such as the condition being treated, the age, weight and health of the patient, and may thus vary among patients. For example, a therapeutically effective adult human or veterinary dosage of the viral vector is generally in the range of from about 100 μL to about 100 mL of a carrier containing concentrations of from about $1 \times 10^6$ to about $1 \times 10^{15}$ particles, about $1 \times 10^{11}$ to $1 \times 10^{13}$ particles, or about $1 \times 10^9$ to $1 \times 10^{12}$ particles virus. Dosages will range depending upon the size of the animal and the route of administration. For example, a suitable human or veterinary dosage (for about an 80 kg animal) for intramuscular injection is in the range of about $1 \times 10^9$ to about $5 \times 10^{12}$ particles per mL, for a single site. Optionally, multiple sites of administration may be delivered. In another example, a suitable human or veterinary dosage may be in the range of about $1 \times 10^{11}$ to about $1 \times 10^{15}$ particles for an oral formulation. One of skill in the art may adjust these doses, depending on the route of administration and the therapeutic or vaccinal application for which the recombinant vector is employed. The levels of expression of the transgene, or for an immunogen, the level of circulating antibody, can be monitored to determine the frequency of dosage administration. Yet other methods for determining the timing of frequency of administration will be readily apparent to one of skill in the art.

An optional method step involves the co-administration to the patient, either concurrently with, or before or after administration of the viral vector, of a suitable amount of a short acting immune modulator. The selected immune modulator is defined herein as an agent capable of inhibiting the formation of neutralizing antibodies directed against the recombinant vector of this invention or capable of inhibiting cytolytic T lymphocyte (CTL) elimination of the vector. The immune modulator may interfere with the interactions between the T helper subsets ($T_{H1}$ or $T_{H2}$) and B cells to inhibit neutralizing antibody formation. Alternatively, the immune modulator may inhibit the interaction between $T_{H1}$ cells and CTLs to reduce the occurrence of CTL elimination of the vector. A variety of useful immune modulators and dosages for use of same are disclosed, for example, in Yang et al., *J. Virol.*, 70(9) (September, 1996); International Patent Application No. WO96/12406, published May 2, 1996; and International Patent Application No. PCT/US96/03035, all incorporated herein by reference.

1. Therapeutic Transgenes

Useful therapeutic products encoded by the transgene include hormones and growth and differentiation factors including, without limitation, insulin, glucagon, growth hormone (GH), parathyroid hormone (PTH), growth hormone releasing factor (GRF), follicle stimulating hormone (FSH), luteinizing hormone (LH), human chorionic gonadotropin (hCG), vascular endothelial growth factor (VEGF), angiopoietins, angiostatin, granulocyte colony stimulating factor (GCSF), erythropoietin (EPO), connective tissue growth factor (CTGF), basic fibroblast growth factor (bFGF), acidic fibroblast growth factor (aFGF), epidermal growth factor (EGF), transforming growth factor (TGF), platelet-derived growth factor (PDGF), insulin growth factors I and II (IGF-I and IGF-II), any one of the transforming growth factor superfamily, including TGF, activins, inhibins, or any of the bone morphogenic proteins (BMP) BMPs 1-15, any one of the heregluin/neuregulin/ARIA/neu differentiation factor (NDF) family of growth factors, nerve growth factor (NGF), brain-derived neurotrophic factor (BDNF), neurotrophins NT-3 and NT-4/5, ciliary neurotrophic factor (CNTF), glial cell line derived neurotrophic factor (GDNF), neurturin, agrin, any one of the family of semaphorins/collapsins, netrin-1 and netrin-2, hepatocyte growth factor (HGF), ephrins, noggin, sonic hedgehog and tyrosine hydroxylase.

Other useful transgene products include proteins that regulate the immune system including, without limitation, cytokines and lymphokines such as thrombopoietin (TPO), interleukins (IL) IL-1 through IL-25 (including, e.g., IL-2, IL-4, IL-12 and IL-18), monocyte chemoattractant protein, leukemia inhibitory factor, granulocyte-macrophage colony stimulating factor, Fas ligand, tumor necrosis factors and, interferons, and, stem cell factor, flk-2/flt3 ligand. Gene products produced by the immune system are also useful in the invention. These include, without limitation, immunoglobulins IgG, IgM, IgA, IgD and IgE, chimeric immunoglobulins, humanized antibodies, single chain antibodies, T cell receptors, chimeric T cell receptors, single chain T cell receptors, class I and class II MHC molecules, as well as engineered immunoglobulins and MHC molecules. Useful gene products also include complement regulatory proteins such as complement regulatory proteins, membrane cofactor protein (MCP), decay accelerating factor (DAF), CR1, $CF_2$ and CD59.

Still other useful gene products include any one of the receptors for the hormones, growth factors, cytokines, lymphokines, regulatory proteins and immune system proteins. The invention encompasses receptors for cholesterol regulation, including the low density lipoprotein (LDL) receptor, high density lipoprotein (HDL) receptor, the very low density lipoprotein (VLDL) receptor, and the scavenger receptor. The invention also encompasses gene products such as members of the steroid hormone receptor superfamily including glucocorticoid receptors and estrogen receptors, Vitamin D receptors and other nuclear receptors. In addition, useful gene products include transcription factors such as jun, fos, max, mad, serum response factor (SRF), AP-1, AP2, myb, MyoD and myogenin, ETS-box containing proteins, TFE3, E2F, ATF1, ATF2, ATF3, ATF4, ZF5, NFAT, CREB, HNF-4, C/EBP, SP1, CCAAT-box binding proteins, interferon regulation factor (IRF-1), Wilms tumor protein, ETS-binding protein, STAT, GATA-box binding proteins, e.g., GATA-3, and the forkhead family of winged helix proteins.

Other useful gene products include, carbamoyl synthetase I, ornithine transcarbamylase, arginosuccinate synthetase, arginosuccinate lyase, arginase, fumarylacetacetate hydrolase, phenylalanine hydroxylase, alpha-1 antitrypsin, glucose-6-phosphatase, porphobilinogen deaminase, factor VIII, factor IX, cystathione beta-synthase, branched chain ketoacid decarboxylase, albumin, isovaleryl-coA dehydrogenase, propionyl CoA carboxylase, methyl malonyl CoA mutase, glutaryl CoA dehydrogenase, insulin, beta-glucosidase, pyruvate carboxylate, hepatic phosphorylase, phosphorylase kinase, glycine decarboxylase, H-protein, T-protein, a cystic fibrosis transmembrane regulator (CFTR) sequence, and a dystrophin cDNA sequence.

Other useful gene products include non-naturally occurring polypeptides, such as chimeric or hybrid polypeptides having a non-naturally occurring amino acid sequence containing insertions, deletions or amino acid substitutions. For example, single-chain engineered immunoglobulins could be useful in certain immunocompromised patients. Other types of non-naturally occurring gene sequences include antisense molecules and catalytic nucleic acids, such as ribozymes, which could be used to reduce overexpression of a target.

Reduction and/or modulation of expression of a gene are particularly desirable for treatment of hyperproliferative conditions characterized by hyperproliferating cells, as are cancers and psoriasis. Target polypeptides include those polypeptides which are produced exclusively or at higher levels in hyperproliferative cells as compared to normal cells. Target antigens include polypeptides encoded by oncogenes such as myb, myc, fyn, and the translocation gene bcr/abl, ras, src, P53, neu, trk and EGRF. In addition to oncogene products as target antigens, target polypeptides for anti-cancer treatments and protective regimens include variable regions of antibodies made by B cell lymphomas and variable regions of T cell receptors of T cell lymphomas which, in some embodiments, are also used as target antigens for autoimmune disease. Other tumor-associated polypeptides can be used as target polypeptides such as polypeptides which are found at higher levels in tumor cells including the polypeptide recognized by monoclonal antibody 17-1A and folate binding polypeptides.

Other suitable therapeutic polypeptides and proteins include those which may be useful for treating individuals suffering from autoimmune diseases and disorders by conferring a broad based protective immune response against targets that are associated with autoimmunity including cell receptors and cells which produce self-directed antibodies. T cell mediated autoimmune diseases include Rheumatoid arthritis (RA), multiple sclerosis (MS), Sjögren's syndrome, sarcoidosis, insulin dependent diabetes mellitus (IDDM), autoimmune thyroiditis, reactive arthritis, ankylosing spondylitis, scleroderma, polymyositis, dermatomyositis, psoriasis, vasculitis, Wegener's granulomatosis, Crohn's disease and ulcerative colitis. Each of these diseases is characterized by T cell receptors (TCRs) that bind to endogenous antigens and initiate the inflammatory cascade associated with autoimmune diseases.

The simian adenoviral vectors of the invention are particularly well suited for therapeutic regimens in which multiple adenoviral-mediated deliveries of transgenes is desired, e.g., in regimens involving redelivery of the same transgene or in combination regimens involving delivery of other transgenes. Such regimens may involve administration of a SAdV-A1321, SAdV-A1325, SAdV-A1295, SAdV-A1309, SAdV-A1316, or SAdV-A1322 simian adenoviral vector, followed by re-administration with a vector from the same serotype adenovirus. Particularly desirable regimens involve administration of a SAdV-A1321, SAdV-A1325, SAdV-A1295, SAdV-A1309, SAdV-A1316, or SAdV-A1322 simian adenoviral vector, in which the source of the adenoviral capsid sequences of the vector delivered in the first administration differs from the source of adenoviral capsid sequences of the viral vector utilized in one or more of the subsequent administrations. For example, a therapeutic regimen involves administration of a SAdV-A1321, SAdV-A1325, SAdV-A1295, SAdV-A1309, SAdV-A1316, or SAdV-A1322 vector and repeat administration with one or more adenoviral vectors of the same or different serotypes. In another example, a therapeutic regimen involves administration of an adenoviral vector followed by repeat administration with a SAdV-A1321, SAdV-A1325, SAdV-A1295, SAdV-A1309, SAdV-A1316, or SAdV-A1322 vector which has a capsid which differs from the source of the capsid in the first delivered adenoviral vector, and optionally further administration with another vector which is the same or, preferably, differs from the source of the adenoviral capsid of the vector in the prior administration steps. These regimens are not limited to delivery of adenoviral vectors constructed using the SAdV-A1321, SAdV-A1325, SAdV-A1295, SAdV-A1309, SAdV-A1316, or SAdV-A1322 simian sequences. Rather, these regimens can readily utilize other adenoviral sequences, including, without limitation, other simian adenoviral sequences, (e.g., Pan9 or C68, C1, etc), other non-human primate adenoviral sequences, or human adenoviral sequences, in combination with the SAdV-A1321, SAdV-A1325, SAdV-A1295, SAdV-A1309, SAdV-A1316, or SAdV-A1322 vectors. Examples of such simian, other non-human primate and human adenoviral serotypes are discussed elsewhere in this document. Further, these therapeutic regimens may involve either simultaneous or sequential delivery of SAdV-A1321, SAdV-A1325, SAdV-A1295, SAdV-A1309, SAdV-A1316, or SAdV-A1322 adenoviral vectors in combination with non-adenoviral vectors, non-viral vectors, and/or a variety of other therapeutically useful compounds or molecules. The invention is not limited to these therapeutic regimens, a variety of which will be readily apparent to one of skill in the art.

B. Ad-Mediated Delivery of Immunogenic Transgenes

The recombinant SAdV-A1321, SAdV-A1325, SAdV-A1295, SAdV-A1309, SAdV-A1316, or SAdV-A1322 vectors may also be employed as immunogenic compositions. As used herein, an immunogenic composition is a composition to which a humoral (e.g., antibody) or cellular (e.g., a cytotoxic T cell) response is mounted to a transgene product delivered by the immunogenic composition following delivery to a mammal, and preferably a primate. A recombinant simian Ad can contain in any of its adenovirus sequence deletions a gene encoding a desired immunogen. The simian adenovirus is likely to be better suited for use as a live recombinant virus vaccine in different animal species compared to an adenovirus of human origin, but is not limited to such a use. The recombinant adenoviruses can be used as prophylactic or therapeutic vaccines against any pathogen for which the antigen(s) crucial for induction of an immune response and able to limit the spread of the pathogen has been identified and for which the cDNA is available.

Such vaccinal (or other immunogenic) compositions are formulated in a suitable delivery vehicle, as described above. Generally, doses for the immunogenic compositions are in the range defined above for therapeutic compositions. The levels of immunity of the selected gene can be monitored to determine the need, if any, for boosters. Following an assessment of antibody titers in the serum, optional booster immunizations may be desired.

Optionally, a vaccinal composition of the invention may be formulated to contain other components, including, e.g., adjuvants, stabilizers, pH adjusters, preservatives and the like. Such components are well known to those of skill in the vaccine art. Examples of suitable adjuvants include, without limitation, liposomes, alum, monophosphoryl lipid A, and any biologically active factor, such as cytokine, an interleukin, a chemokine, a ligands, and optimally combinations thereof. Certain of these biologically active factors can be expressed in vivo, e.g., via a plasmid or viral vector. For example, such an adjuvant can be administered with a priming DNA vaccine encoding an antigen to enhance the antigen-specific immune response compared with the immune response generated upon priming with a DNA vaccine encoding the antigen only.

The recombinant adenoviruses are administered in a "an immunogenic amount", that is, an amount of recombinant adenovirus that is effective in a route of administration to transfect the desired cells and provide sufficient levels of expression of the selected gene to induce an immune response. Where protective immunity is provided, the recombinant adenoviruses are considered to be vaccine compositions useful in preventing infection and/or recurrent disease.

Alternatively, or in addition, the vectors of the invention may contain a transgene encoding a peptide, polypeptide or protein which induces an immune response to a selected immunogen. The recombinant SAdV vectors described herein are expected to be highly efficacious at inducing cytolytic T cells and antibodies to the inserted heterologous antigenic protein expressed by the vector.

For example, immunogens may be selected from a variety of viral families. Example of viral families against which an immune response would be desirable include, the picornavirus family, which includes the genera rhinoviruses, which are responsible for about 50% of cases of the common cold; the genera enteroviruses, which include polioviruses, coxsackieviruses, echoviruses, and human enteroviruses such as hepatitis A virus; and the genera apthoviruses, which are responsible for foot and mouth diseases, primarily in non-human animals. Within the picornavirus family of viruses, target antigens include the VP1, VP2, VP3, VP4, and VPG. Another viral family includes the calcivirus family, which encompasses the Norwalk group of viruses, which are an important causative agent of epidemic gastroenteritis. Still another viral family desirable for use in targeting antigens for inducing immune responses in humans and non-human animals is the togavirus family, which includes the genera alphavirus, which include Sindbis viruses, RossRiver virus, and Venezuelan, Eastern & Western Equine encephalitis, and rubivirus, including Rubella virus. The flaviviridae family includes dengue, yellow fever, Japanese encephalitis, St. Louis encephalitis and tick borne encephalitis viruses. Other target antigens may be generated from the Hepatitis C or the coronavirus family, which includes a number of non-human viruses such as infectious bronchitis virus (poultry), porcine transmissible gastroenteric virus (pig), porcine hemagglutinating encephalomyelitis virus (pig), feline infectious peritonitis virus (cats), feline enteric coronavirus (cat), canine coronavirus (dog), and human respiratory coronaviruses, which may cause the common cold and/or non-A, B or C hepatitis. Within the coronavirus family, target antigens include the E1 (also called M or matrix protein), E2 (also called S or Spike protein), E3 (also called HE or hemagglutin-elterose) glycoprotein (not present in all coronaviruses), or N (nucleocapsid). Still other antigens may be targeted against the rhabdovirus family, which includes the genera vesiculovirus (e.g., Vesicular Stomatitis Virus), and the general lyssavirus (e.g., rabies).

Within the rhabdovirus family, suitable antigens may be derived from the G protein or the N protein. The family filoviridae, which includes hemorrhagic fever viruses such as Marburg and Ebola virus, may be a suitable source of antigens. The paramyxovirus family includes parainfluenza Virus Type 1, parainfluenza Virus Type 3, bovine parainfluenza Virus Type 3, rubulavirus (mumps virus), parainfluenza Virus Type 2, parainfluenza virus Type 4, Newcastle disease virus (chickens), rinderpest, morbillivirus, which includes measles and canine distemper, and pneumovirus, which includes respiratory syncytial virus. The influenza virus is classified within the family orthomyxovirus and is a suitable source of antigen (e.g., the HA protein, the N1 protein). The bunyavirus family includes the genera bunyavirus (California encephalitis, La Crosse), phlebovirus (Rift Valley Fever), hantavirus (puremala is a hemahagin fever virus), nairovirus (Nairobi sheep disease) and various unassigned bungaviruses. The arenavirus family provides a source of antigens against LCM and Lassa fever virus. The reovirus family includes the genera reovirus, rotavirus (which causes acute gastroenteritis in children), orbiviruses, and cultivirus (Colorado Tick fever, Lebombo (humans), equine encephalosis, blue tongue).

The retrovirus family includes the sub-family oncorivirinal which encompasses such human and veterinary diseases as feline leukemia virus, HTLVI and HTLVII, lentivirinal (which includes human immunodeficiency virus (HIV), simian immunodeficiency virus (SIV), feline immunodeficiency virus (FIV), equine infectious anemia virus, and spumavirinal). Among the lentiviruses, many suitable antigens have been described and can readily be selected. Examples of suitable HIV and SIV antigens include, without limitation the gag, pol, Vif, Vpx, VPR, Env, Tat, Nef, and Rev proteins, as well as various fragments thereof. For example, suitable fragments of the Env protein may include any of its subunits such as the gp120, gp160, gp41, or smaller fragments thereof, e.g., of at least about 8 amino acids in length. Similarly, fragments of the tat protein may be selected. [See, U.S. Pat. No. 5,891, 994 and U.S. Pat. No. 6,193,981.] See, also, the HIV and SIV proteins described in D. H. Barouch et al, J. Virol., 75(5): 2462-2467 (March 2001), and R. R. Amara, et al, *Science*, 292:69-74 (6 Apr. 2001). In another example, the HIV and/or SIV immunogenic proteins or peptides may be used to form fusion proteins or other immunogenic molecules. See, e.g., the HIV-1 Tat and/or Nef fusion proteins and immunization regimens described in WO 01/54719, published Aug. 2, 2001, and WO 99/16884, published Apr. 8, 1999. The invention is not limited to the HIV and/or SIV immunogenic proteins or peptides described herein. In addition, a variety of modifications to these proteins has been described or could readily be made by one of skill in the art. See, e.g., the modified gag protein that is described in U.S. Pat. No. 5,972,596. Further, any desired HIV and/or SIV immunogens may be delivered alone or in combination. Such combinations may include expression from a single vector or from multiple vectors. Optionally, another combination may involve delivery of one or more expressed immunogens with delivery of one or more of the immunogens in protein form. Such combinations are discussed in more detail below.

The papovavirus family includes the sub-family polyomaviruses (BKU and JCU viruses) and the sub-family papillomavirus (associated with cancers or malignant progression of papilloma). The adenovirus family includes viruses (EX, AD7, ARD, O.B.) which cause respiratory disease and/or enteritis. The parvovirus family feline parvovirus (feline enteritis), feline panleucopeniavirus, canine parvovirus, and porcine parvovirus. The herpesvirus family includes the sub-family alphaherpesvirinae, which encompasses the genera simplexvirus (HSVI, HSVII), varicellovirus (pseudorabies, varicella zoster) and the sub-family betaherpesvirinae, which includes the genera cytomegalovirus (HCMV, muromegalovirus) and the sub-family gammaherpesvirinae, which includes the genera lymphocryptovirus, EBV (Burkitts lymphoma), infectious rhinotracheitis, Marek's disease virus, and rhadinovirus. The poxvirus family includes the sub-family chordopoxyirinae, which encompasses the genera orthopoxvirus (Variola (Smallpox) and Vaccinia (Cowpox)), parapoxvirus, avipoxvirus, capripoxvirus, leporipoxvirus, suipoxvirus, and the sub-family entomopoxyirinae. The hepadnavirus family includes the Hepatitis B virus. One unclassified virus which may be suitable source of antigens is the Hepatitis delta virus. Still other viral sources may include avian infectious bursal disease virus and porcine respiratory and reproductive syndrome virus. The alphavirus family includes equine arteritis virus and various Encephalitis viruses.

Immunogens which are useful to immunize a human or non-human animal against other pathogens include, e.g., bacteria, fungi, parasitic microorganisms or multicellular parasites which infect human and non-human vertebrates, or from a cancer cell or tumor cell. Examples of bacterial pathogens include pathogenic gram-positive cocci include pneumococci; staphylococci; and streptococci. Pathogenic gram-negative cocci include meningococcus; gonococcus. Pathogenic enteric gram-negative bacilli include enterobacteriaceae; pseudomonas, acinetobacteria and *eikenella*; melioidosis; *salmonella; shigella; haemophilus; moraxella; H. ducreyi* (which causes chancroid); *brucella; Franisella tularensis* (which causes tularemia); *Yersinia* (pasteurella); *streptobacillus moniliformis* and *spirillum*; Gram-positive bacilli include *listeria monocytogenes; erysipelothrix rhusiopathiae; Corynebacterium diphtheria* (diphtheria); cholera; *B. anthracis* (anthrax); donovanosis (granuloma inguinale); and bartonellosis. Diseases caused by pathogenic anaerobic bacteria include tetanus; botulism; other clostridia; tuberculosis; leprosy; and other mycobacteria. Pathogenic spirochetal diseases include syphilis; treponematoses: yaws, pinta and endemic syphilis; and leptospirosis. Other infections caused by higher pathogen bacteria and pathogenic fungi include actinomycosis; nocardiosis; cryptococcosis, blastomycosis, histoplasmosis and coccidioidomycosis; candidiasis, aspergillosis, and mucormycosis; sporotrichosis; paracoccidiodomycosis, petriellidiosis, torulopsosis, mycetoma and *chromomycosis*; and dermatophytosis. Rickettsial infections include Typhus fever, Rocky Mountain spotted fever, Q fever, and Rickettsialpox. Examples of mycoplasma and chlamydial infections include: *mycoplasma pneumoniae*; lymphogranuloma venereum; psittacosis; and perinatal chlamydial infections. Pathogenic eukaryotes encompass pathogenic protozoa and helminthes and infections produced thereby include: amebiasis; malaria; leishmaniasis; trypanosomiasis; toxoplasmosis; *Pneumocystis carinii; Trichans; Toxoplasma gondii*; babesiosis; giardiasis; trichinosis; filariasis; schistosomiasis; nematodes; trematodes or flukes; and cestode (tapeworm) infections.

Many of these organisms and/or toxins produced thereby have been identified by the Centers for Disease Control [(CDC), Department of Heath and Human Services, USA], as agents which have potential for use in biological attacks. For example, some of these biological agents, include, *Bacillus anthracis* (anthrax), *Clostridium botulinum* and its toxin (botulism), *Yersinia pestis* (plague), variola major (smallpox), *Francisella* tularensis (tularemia), and viral hemorrhagic fevers [filoviruses (e.g., Ebola, Marburg], and arenaviruses [e.g., Lassa, Machupo]), all of which are currently classified as Category A agents; *Coxiella burnetti* (Q fever); *Brucella* species (brucellosis), *Burkholderia mallei* (glanders), *Burkholderia* pseudomallei (meloidosis), *Ricinus communis* and its toxin (ricin toxin), *Clostridium perfringens* and its toxin (epsilon toxin), *Staphylococcus* species and their toxins (enterotoxin B), *Chlamydia psittaci* (psittacosis), water safety threats (e.g., *Vibrio cholerae, Crytosporidium parvum*), Typhus fever (*Richettsia powazekii*), and viral encephalitis (alphaviruses, e.g., Venezuelan equine encephalitis; eastern equine encephalitis; western equine encephalitis); all of which are currently classified as Category B agents; and Nipan virus and hantaviruses, which are currently classified as Category C agents. In addition, other organisms, which are so classified or differently classified, may be identified and/or used for such a purpose in the future. It will be readily understood that the viral vectors and other constructs described herein are useful to deliver antigens from these organisms, viruses, their toxins or other by-products, which will prevent and/or treat infection or other adverse reactions with these biological agents.

Administration of the SAdV-A1321, SAdV-A1325, SAdV-A1295, SAdV-A1309, SAdV-A1316, or SAdV-A1322 vectors to deliver immunogens against the variable region of the T cells are anticipated to elicit an immune response including CTLs to eliminate those T cells. In RA, several specific variable regions of TCRs which are involved in the disease have been characterized. These TCRs include V-3, V-14, V-17 and Va-17. Thus, delivery of a nucleic acid sequence that encodes at least one of these polypeptides will elicit an immune response that will target T cells involved in RA. In MS, several specific variable regions of TCRs which are involved in the disease have been characterized. These TCRs include V-7 and Va-10. Thus, delivery of a nucleic acid sequence that encodes at least one of these polypeptides will elicit an immune response that will target T cells involved in MS. In scleroderma, several specific variable regions of TCRs which are involved in the disease have been characterized. These TCRs include V-6, V-8, V-14 and Va-16, Va-3C, Va-7, Va-14, Va-15, Va-16, Va-28 and Va-12. Thus, delivery of a recombinant simian adenovirus that encodes at least one of these polypeptides will elicit an immune response that will target T cells involved in scleroderma.

C. Ad-Mediated Delivery Methods

The therapeutic levels, or levels of immunity, of the selected gene can be monitored to determine the need, if any, for boosters. Following an assessment of CD8+ T cell response, or optionally, antibody titers, in the serum, optional booster immunizations may be desired. Optionally, the recombinant SAdV-A1321, SAdV-A1325, SAdV-A1295, SAdV-A1309, SAdV-A1316, or SAdV-A1322 vectors may be delivered in a single administration or in various combination regimens, e.g., in combination with a regimen or course of treatment involving other active ingredients or in a prime-boost regimen. A variety of such regimens has been described in the art and may be readily selected.

For example, prime-boost regimens may involve the administration of a DNA (e.g., plasmid) based vector to prime the immune system to second, booster, administration with a traditional antigen, such as a protein or a recombinant virus carrying the sequences encoding such an antigen. See, e.g., WO 00/11140, published Mar. 2, 2000, incorporated by reference. Alternatively, an immunization regimen may involve the administration of a recombinant SAdV-A1321, SAdV-A1325, SAdV-A1295, SAdV-A1309, SAdV-A1316, or SAdV-A1322 vector to boost the immune response to a vector (either viral or DNA-based) carrying an antigen, or a protein. In still another alternative, an immunization regimen involves administration of a protein followed by booster with a vector encoding the antigen.

In one embodiment, a method of priming and boosting an immune response to a selected antigen by delivering a plasmid DNA vector carrying said antigen, followed by boosting with a recombinant SAdV-A1321, SAdV-A1325, SAdV-A1295, SAdV-A1309, SAdV-A1316, or SAdV-A1322 vector is described. In one embodiment, the prime-boost regimen involves the expression of multiproteins from the prime and/or the boost vehicle. See, e.g., R. R. Amara, *Science*, 292:69-74 (6 Apr. 2001) which describes a multiprotein regimen for expression of protein subunits useful for generating an immune response against HIV and SIV. For example, a DNA prime may deliver the Gag, Pol, Vif, VPX and Vpr and Env, Tat, and Rev from a single transcript. Alternatively, the SIV Gag, Pol and HIV-1 Env is delivered in a recombinant SAdV-A1321, SAdV-A1325, SAdV-A1295, SAdV-A1309, SAdV-A1316, or SAdV-A1322 adenovirus construct. Still other regimens are described in WO 99/16884 and WO 01/54719.

However, the prime-boost regimens are not limited to immunization for HIV or to delivery of these antigens. For example, priming may involve delivering with a first SAdV-A1321, SAdV-A1325, SAdV-A1295, SAdV-A1309, SAdV-A1316, or SAdV-A1322 vector followed by boosting with a second Ad vector, or with a composition containing the antigen itself in protein form. In one example, the prime-boost regimen can provide a protective immune response to the virus, bacteria or other organism from which the antigen is derived. In another embodiment, the prime-boost regimen provides a therapeutic effect that can be measured using convention assays for detection of the presence of the condition for which therapy is being administered.

The priming composition may be administered at various sites in the body in a dose dependent manner, which depends on the antigen to which the desired immune response is being targeted. The amount or situs of injection(s) or to pharmaceutical carrier is not a limitation. Rather, the regimen may involve a priming and/or boosting step, each of which may include a single dose or dosage that is administered hourly, daily, weekly or monthly, or yearly. As an example, the mammals may receive one or two doses containing between about 10 µg to about 50 µg of plasmid in carrier. A desirable amount of a DNA composition ranges between about 1 µg to about 10,000 µg of the DNA vector. Dosages may vary from about 1 µg to 1000 µg DNA per kg of subject body weight. The amount or site of delivery is desirably selected based upon the identity and condition of the mammal.

The dosage unit of the vector suitable for delivery of the antigen to the mammal is described herein. The vector is prepared for administration by being suspended or dissolved in a pharmaceutically or physiologically acceptable carrier such as isotonic saline; isotonic salts solution or other formulations that will be apparent to those skilled in such administration. The appropriate carrier will be evident to those skilled in the art and will depend in large part upon the route of administration. The compositions described herein may be administered to a mammal according to the routes described above, in a sustained release formulation using a biodegradable biocompatible polymer, or by on-site delivery using micelles, gels and liposomes. Optionally, the priming step also includes administering with the priming composition, a suitable amount of an adjuvant, such as are defined herein.

Preferably, a boosting composition is administered about 2 to about 27 weeks after administering the priming composition to the mammalian subject. The administration of the boosting composition is accomplished using an effective amount of a boosting composition containing or capable of delivering the same antigen as administered by the priming DNA vaccine. The boosting composition may be composed of a recombinant viral vector derived from the same viral source (e.g., adenoviral sequences of the invention) or from another source. Alternatively, the "boosting composition" can be a composition containing the same antigen as encoded in the priming DNA vaccine, but in the form of a protein or peptide, which composition induces an immune response in the host. In another embodiment, the boosting composition contains a DNA sequence encoding the antigen under the control of a regulatory sequence directing its expression in a mammalian cell, e.g., vectors such as well-known bacterial or viral vectors. The primary requirements of the boosting composition are that the antigen of the composition is the same antigen, or a cross-reactive antigen, as that encoded by the priming composition.

In another embodiment, the SAdV-A1321, SAdV-A1325, SAdV-A1295, SAdV-A1309, SAdV-A1316, or SAdV-A1322 vectors are also well suited for use in a variety of other immunization and therapeutic regimens. Such regimens may involve delivery of SAdV-A1321, SAdV-A1325, SAdV-A1295, SAdV-A1309, SAdV-A1316, or SAdV-A1322 vectors simultaneously or sequentially with Ad vectors of different serotype capsids, regimens in which SAdV-A1321, SAdV-A1325, SAdV-A1295, SAdV-A1309, SAdV-A1316, or SAdV-A1322 vectors are delivered simultaneously or sequentially with non-Ad vectors, regimens in which the SAdV-A1321, SAdV-A1325, SAdV-A1295, SAdV-A1309, SAdV-A1316, or SAdV-A1322 vectors are delivered simultaneously or sequentially with proteins, peptides, and/or other biologically useful therapeutic or immunogenic compounds. Such uses will be readily apparent to one of skill in the art.

In still another embodiment, the invention provides the use of capsid of these viruses (optionally an intact or recombinant viral particle or an empty capsid is used) to induce an immunomodulatory effect response, or to enhance or adjuvant a cytotoxic T cell response to another active agent by delivering an adenovirus SAdV-A1321, SAdV-A1325, SAdV-A1295, SAdV-A1309, SAdV-A1316, or SAdV-A1322 capsid to a subject. The SAdV-A1321, SAdV-A1325, SAdV-A1295, SAdV-A1309, SAdV-A1316, or SAdV-A1322 capsid can be delivered alone or in a combination regimen with an active agent to enhance the immune response thereto. Advantageously, the desired effect can be accomplished without infecting the host with a subgroup E adenovirus. In another aspect, a method of inducing interferon alpha production in a subject in need thereof comprising delivering the SAdV- A1321, SAdV-A1325, SAdV-A1295, SAdV-A1309, SAdV-A1316, or SAdV-A1322 capsid to a subject is provided. In still another aspect, a method for producing one or more cytokines (e.g., IFN-α)/chemokines in culture is provided. This method involves incubating a culture containing dendritic cells and the SAdV-A1321, SAdV-A1325, SAdV-A1295, SAdV-A1309, SAdV-A1316, or SAdV-A1322 capsid described herein under conditions suitable to produce cytokines/chemokines, including, alpha interferon, among others.

The cytokines so produced are useful in a variety of applications. For example, in the case of IFNα, the production described herein is particularly desirable, as it is believed that it will provide advantages over commercially available recombinantly produced IFNα, which contain only one or two subtypes of IFNα produced in bacteria. In contrast, the method is anticipated to produce multiple subtypes of natural human IFNα, which is expected to result in a broader spectrum of action. It is believed that each subtype employs a specific biological activity. Further, it is anticipated that the natural interferon produced by the method provided herein will be immunologically indistinguishable from the patient's naturally produced interferon, thereby reducing the risk of the drug being rejected by the subject's immune system, usually caused by the formation of neutralizing antibodies against recombinantly produced interferons.

Other cytokines produced by the subgroup E adenoviruses include, interleukin (IL)-6, IL-8, IP-10, macrophage inflammatory protein-1 alpha (MIP-1α), RANTES, and tumor necrosis factor alpha. Methods of purifying these cytokines/chemokines from culture and therapeutic or adjuvant uses of these cytokines/chemokines have been described in the literature. Further, commercially available columns or kits may used for purification of the cytokines/chemokines prepared according to the invention. The cytokines/chemokines produced using the invention may be formulated for use in a variety of indications.

For example, cytokines described herein include, interferon alpha (IFNα), tumor necrosis factor alpha (TNFα), IP-10 (Interferon gamma Inducible Protein), interleukin-6 (IL-6), and IL-8. IFNα has been described as being useful in treatment of influenza, hepatitis (including, e.g., hepatitis B and C), and a variety of neoplasms, e.g., kidney (renal cell carcinoma), melanoma, malignant tumor, multiple myeloma, carcinoid tumor, lymphoma and leukemia (e.g., chronic myelogenous leukemia and hairy cell leukemia). A mixture of IFNα subtypes produced as described herein can be purified using known techniques. See, e.g., WO 2006/085092, which describes the use of monoclonal antibodies and column purification. Other techniques have been described in the literature. IFNα produced as described herein can be purified using known methods. See, e.g., U.S. Pat. No. 4,680,260, U.S. Pat. No. 4,732,683, and G. Allen, Biochem J., 207:397-408 (1982). TNFα has been described as being useful in treatment in autoimmune disorders including, e.g., psoriasis and rheumatoid arthritis. IP-10, Interferon gamma Inducible Protein, can be used as a potent inhibitor of angiogenesis and to have a potent thymus-dependent anti-tumor effect.

A method for producing IFNα by incubating a culture containing dendritic cells and a SAdV-A1321, SAdV-A1325, SAdV-A1295, SAdV-A1309, SAdV-A1316, or SAdV-A1322 capsid under conditions suitable to produce cytokines is provided. In one embodiment, blood is drawn from healthy donors (preferably human) and peripheral blood leukocytes (PBL) or peripheral blood mononuclear cells (PBMC) are prepared using known techniques. In one embodiment, PBL are used as the cytokine-producing cells according to the method of the invention. In another embodiment, PBMC are used as the cytokine-producing cells. In another embodiment, plasmacytoid dendritic cells are isolated from the PBL or PBMC using known techniques, e.g., using the commercially available kit "human plasmacytoid dendritic cell isolation kit" by Miltenyi Biotec GmbH (Germany). The selected cells are cultured in suspension with an appropriate media and the adenovirus subgroup E capsid protein. Appropriate media can be readily determined by one of skill in the art. However, in one embodiment, the media is a RPMI-1640 medium. Alternatively, other media may be readily selected. The cells may be cultured in a suitable vessel, e.g., a microtiter well, a flask, or a larger vessel. In one embodiment, the concentration of the cells is about 1 million cells/mL culture media. However, other suitable cell concentrations may be readily determined by one of skill in the art. The invention does not require the use of interferons as primers. However, if desired, the media may include a suitable cytokine, IL-3, in order to stimulate cell growth. One suitable concentration is about 20 ng/mL. However, other concentrations may be used. In one embodiment, the SAdV-A1321, SAdV-A1325, SAdV-A1295, SAdV-A1309, SAdV-A1316, or SAdV-A1322 capsid protein is introduced into the culture containing the cells. The adenovirus capsid protein can be delivered to the culture in any of the forms described herein (e.g., a viral particle, including an empty capsid particle, a viral vector having an SAdV-A1321, SAdV-A1325, SAdV-A1295, SAdV-A1309, SAdV-A1316, or SAdV-A1322 capsid, and the like). Typically the capsid protein will be suspended in a suitable carrier, e.g., culture media, saline, or the like. Suitably, the SAdV-A1321, SAdV-A1325, SAdV-A1295, SAdV-A1309, SAdV-A1316, or SAdV-A1322 capsid is added to the culture in an amount of about 100 to 100,000 adenovirus subgroup E particles per cell. The mixture is then incubated, e.g., in the range of about 28° C. to about 40° C., in the range from about 35° C. to about 37° C., or about 37° C. Typically, approximately 12 to 96 hours, or about 48 hours later, cells are spun down and the supernatant is collected. Suitably, this is performed under conditions which avoid cell lysis, thereby reducing or eliminating the presence of cellular debris in the supernatant. Centrifugation permits separation of the cytokines from the cells, thereby providing a crudely isolated cytokine. Sizing columns, and other known columns and methods are available for further purification of cytokines from adenoviruses and adenoviral capsids, and the like. These cytokines, so purified, are available for formulation and use in a variety of applications.

In one embodiment, an empty SAdV-A1321, SAdV-A1325, SAdV-A1295, SAdV-A1309, SAdV-A1316, or SAdV-A1322 particle (i.e., an adenoviral capsid having no DNA packaged therein which expresses any adenoviral or transgene product) may be delivered to the cells. In another embodiment, a non-infectious wild-type SAdV-A1321, SAdV-A1325, SAdV-A1295, SAdV-A1309, SAdV-A1316, or SAdV-A1322 particle or a recombinant adenoviral vector packaged in an SAdV-A1321, SAdV-A1325, SAdV-A1295, SAdV-A1309, SAdV-A1316, or SAdV-A1322 capsid (particle) may be used. Suitable techniques for inactivating such viral particles are known in the art and may include without limitation, e.g., UV irradiation (which effectively cross-links genomic DNA preventing expression).

The following examples describe the cloning of SAdV-A1321, SAdV-A1325, SAdV-A1295, SAdV-A1309, SAdV-A1316, or SAdV-A1322 and the construction of exemplary recombinant SAdV-A1321, SAdV-A1325, SAdV-A1295, SAdV-A1309, SAdV-A1316, or SAdV-A1322 vectors. These examples are illustrative only, and do not limit the scope of the present invention.

EXAMPLE 1

Isolation of Simian Adenoviruses

Stool samples were obtained from the chimpanzee colony at the University of Louisiana New Iberia Research Center, 4401 W. Admiral Doyle Drive, New Iberia, La., USA. Filtered supernatants from the stool suspensions were inoculated into cultures of the human cell line A549. After about 1 to 2 weeks in culture, visual cytopathic effect (CPE) was obvious in cell cultures with several of the inocula. The viruses that were isolated by this technique were amplified to a large-scale preparation using A549 cells using the standard adenovirus purification method of cesium chloride gradient banding. DNA from the purified adenoviruses was isolated and completely sequenced by Qiagen Genomics services, Hilden, Germany. Analysis of the complete genomic sequence showed that the isolated virus had a novel sequence that had not been previously reported.

Based on the phylogenetic analysis of the viral DNA sequences, the adenoviruses designated simian adenovirus A1321 (SAdV-A1321), SAdV-A1325, SAdV-A1295, SAdV-A1309, SAdV-A1316, and SAdV-A1322, were determined to be in the same subgroup as subgroup (species) E. Average yields for viral amplification were as follows: A1321 ($1.44 \times 10^{13}$), SAdV-A1325 ($2.73 \times 10^{13}$), SAdV-A1295 ($1.2 \times 10^{13}$), SAdV-A1309 ($2.57 \times 10^{13}$), SAdV-A1316 ($5.58 \times 10^{13}$), and SAdV-A1322 ($4.71 \times 10^{13}$).

EXAMPLE 2

Vector Construction

An E1 deleted vector using SAdV-A1321, SAdV-A1325, SAdV-A1295, SAdV-A1309, SAdV-A1316, or SAdV-A1322 (subgroup E) may be prepared generally as described.

A linker containing SmaI, ClaI, XbaI, SpeI, EcoRV sites flanked by SwaI is cloned into pBR322 cut with EcoRI and NdeI. Viral DNA is digested with XbaI and the 6 kb fragments (left and right ends) are gel purified and ligated into pSR5 digested with SmaI and XbaI. 12 minipreps are diagnosed with SmaI and assessed for expected fragment sizes. Minipreps are sequenced to check the integrity of the viral DNA end. The sequence obtained is used to correct the left end Qiagen sequence and deduce the correct right ITR sequence as well.

The plasmid is digested with SnaBI+NdeI and the NdeI site is filled in with Klenow. The EcoRV fragment from pBleuSK I-PI is ligated in. Alternatively the plasmid is digested by SnaBI and NdeI and a double stranded oligonucleotide containing recognition sites for CeuI and PI-SceI is ligated in place of deleted E1 coding regions. Minipreps are diagnosed using PstI. The resulting plasmid is digested with XbaI+EcoRV. The right end (XbaI digest) fragment from the SAdV-A1321, SAdV-A1325, SAdV-A1295, SAdV-A1309, SAdV-A1316, or SAdV-A1322 is ligated in. Minipreps are diagnosed using ApaLI. The resulting plasmid is then digested with XbaI+EcoRV. The fragment from the SAdV-A1321, SAdV-A1325, SAdV-A1295, SAdV-A1309, SAdV-A1316, or SAdV-A1322 DNA is ligated in and minipreps are diagnosed using MfeI. 293 cells are then transfected using calcium phosphate or lipofectamine methods according to manufacturer's protocol.

EXAMPLE 3

Assessment of Cross-Neutralizing Antibodies

A. Wild-type SAdV-A1321, SAdV-A1325, SAdV-A1295, SAdV-A1309, SAdV-A1316, and SAdV-A1322 are assessed for cross-neutralizing activity as compared to human Adenovirus 5 (subspecies C) and chimpanzee adenovirus 7 (SAdV-24), and human pooled IgG using an infection inhibition neutralizing antibody assay monitored by direct immunofluorescence. The human pooled IgG [Hu Pooled IgG] is purchased commercially and is approved for administration in immunocompromised patients, as it contains antibodies against a number of antigens to which the general human population is exposed. The presence or absence of neutralizing antibodies to the simian adenoviruses for the human pooled IgG is a reflection of the prevalence of antibodies to these adenoviruses in the general population.

The assay is performed as follows. Serum samples obtained from rabbits previously injected with HAdV-5 or SAdV-24 are heat inactivated at 56° C. for 35 min. Wild type adenovirus ($10^8$ particles/well) are diluted in serum-free Dulbecco's modified Eagle's medium (DMEM) and incubated with 2-fold serial dilutions of heat-inactivated serum samples in DMEM for 1 h at 37° C. Subsequently, the serum-adenovirus mixture is added to slides in wells with 105 monolayer A549 cells. After 1 hr, the cells in each well are supplemented with 100 µl of 20% fetal bovine serum (FBS)-DMEM and cultured for 22 h at 37° C. in 5% $CO_2$. Next, cells are rinsed twice with PBS and stained with DAPI and a goat, FITC labeled, broadly cross reactive antibody (Virostat) raised against HAdV-5 following fixation in paraformaldehyde (4%, 30 min) and permeabilization in 0.2% Triton (4° C., 20 min) The level of infection is determined by counting the number of FITC positive cells under microscopy. The NAB titer is reported as the highest serum dilution that inhibits adenovirus infection by 50% or more, compared with the naive serum control. Where a titer value of <1/20 is shown, the neutralizing antibody concentration is under the limit of detection, i.e., 1/20.

B. Wild-type SAdV-A1321, SAdV-A1325, SAdV-A1295, SAdV-A1309, SAdV-A1316, and SAdV-A1322 were assessed for cross-neutralizing activity as compared to human Adenovirus 5 (HAdV-5; subspecies C). The results are shown in Table 3 below. Less than approximately 15% of the population of human samples (n=20) had a neutralizing antibody titer (NAb titer) greater than 200 for the identified adenoviruses, relative to approximately 40% for HAdV-5.

TABLE 3

| Wild type adenovirus | IVIG Nab titer (10 mlg/ml) | Human samples (n = 20) Nab titer | |
|---|---|---|---|
| | | Median | Mean |
| A1295 | 20 | 20 | 40 |
| A1309 | 80 | 60 | 113 |
| A1316 | 40 | 80 | 91 |
| A1321 | 20 | 40 | 40 |
| A1322 | 40 | 40 | 69 |
| A1325 | 80 | 80 | 88 |
| HAdV-5 | 640 | 640 | 1589 |

EXAMPLE 4

Vector Construction

A. SAdV-A1321

An E1 deleted SAdV-A1321 vector is prepared by digesting the pSR5 plasmid (SEQ ID NO: 322) with SmaI+XbaI, and the wild-type SAdV-A1321 sequence (SEQ ID NO: 1) with Xba I to produce an ~6020 bp fragment for incorporation into the plasmid. The resulting plasmid (pS215-1321) is digested with BsiWI+NdeI or with SnaBI+NdeI, and ICeuPI-SceI meganuclease cassette(s) (SEQ ID NO: 326) cloned therein via SnaIB (BsiWI)+NdeI sites. The resulting plasmid (pS216-1321) is then digested with EcoRV+XbaI, and the ~30526 bp fragment of wild-type SAdV-A1321 sequence (SEQ ID NO: 1) digested with XbaI is cloned therein resulting in the pS217-A1321 plasmid.

A suitable transgene expression cassette is then introduced into the pS217-A1321 plasmid. The transgene may be, e.g., a reporter such as eGFP, an influenza A nucleoprotein, or HIV-gag (e.g., from pSh-HIV-short-gag (SEQ ID NO: 319)) via the I-CeuI and PI-SceI sites of the meganuclease cassette. Additional transgenes described herein and known in the art may be used consistent with this example and the skill in the art and are contemplated hereby.

A proposed E1 deleted SAdV-A1321 vector containing an HIV-gag transgene is identified in SEQ ID NO: 168.

B. SAdV-A1325

An E1 deleted SAdV-A1325 vector is prepared by digesting the pSR5 plasmid (SEQ ID NO: 322) with SmaI+XbaI, and the wild-type SAdV-A1325 sequence (SEQ ID NO: 28) with Xba I to produce an ~5728 bp fragment for incorporation into the plasmid. The resulting plasmid (pS226-1325) is digested with BsiWI+NdeI or with SnaBI+NdeI, and ICeuPI-SceI meganuclease cassette(s) (SEQ ID NO: 326) cloned therein via SnaIB (BsiWI)+NdeI sites. The resulting plasmid (pS227-1325) is then digested with EcoRV+XbaI, and the ~30507 bp fragment of wild-type SAdV-A1325 sequence (SEQ ID NO: 28) digested with XbaI is cloned therein resulting in the pS228-A1325 plasmid.

A suitable transgene expression cassette is then introduced into the pS228-A1325 plasmid. The transgene may be, e.g., a reporter such as eGFP, an influenza A nucleoprotein, or HIV-gag (e.g., from pSh-HIV-short-gag (SEQ ID NO: 319)) via the I-CeuI and PI-SceI sites of the meganuclease cassette. Additional transgenes described herein and known in the art may be used consistent with this example and the skill in the art and are contemplated hereby.

A proposed E1 deleted SAdV-A1325 vector containing an HIV-gag transgene is identified in SEQ ID NO: 193.

C. SAdV-A1295

An E1 deleted SAdV-A1295 vector is prepared by digesting the pSR5 plasmid (SEQ ID NO: 322) with SmaI+XbaI, and the wild-type SAdV-A1295 sequence (SEQ ID NO: 57) with Xba I to produce an ~6017 bp fragment for incorporation into the plasmid. The resulting plasmid (pS200-1295) is digested with BsiWI+NdeI and the ends are filled in with Klenow and treated with CIP. The pBleuSK I-PI plasmid (SEQ ID NO: 324) is digested with EcoRV and the EcoRV fragment from pBleuSK I-PI (harboring sites for I-CeuI and PI-SceI) was ligated in. The resulting plasmid (pS201-1295) is then digested with EcoRV+XbaI, and the ~6521 bp fragment of wild-type SAdV-A1295 sequence (SEQ ID NO: 57) digested with XbaI is cloned therein resulting in the pS202-A1295 plasmid. The pS202-A1295 plasmid is then digested with XbaI and the ~24105 bp fragment of wild-type SAdV-A1295 sequence (SEQ ID NO: 57) digested with XbaI is cloned therein resulting in the pS203-A1295 plasmid.

A suitable transgene expression cassette is then introduced into the pS203-A1295 plasmid. The transgene may be, e.g., a reporter such as eGFP, an influenza A nucleoprotein, or HIV-gag (e.g., from pSh-HIV-short-gag (SEQ ID NO: 319)) via the I-CeuI and PI-SceI sites of the pBleuSK I-PI plasmid fragment. Additional transgenes described herein and known in the art may be used consistent with this example and the skill in the art and are contemplated hereby.

A proposed E1 deleted SAdV-A1295 vector containing an HIV-gag transgene is identified in SEQ ID NO: 220.

D. SAdV-A1309

An E1 deleted SAdV-A1309 vector is prepared by digesting the pSR5 plasmid (SEQ ID NO: 322) with SmaI+XbaI, and the wild-type SAdV-A1309 sequence (SEQ ID NO: 86) with Xba I to produce an ~6037 bp fragment for incorporation into the plasmid. The resulting plasmid (pS205-1309) is digested with NsiWI+NedI or with SnaBI+NdeI and ICeuPI-SceI meganuclease cassette(s) (SEQ ID NO: 326) cloned therein via SnaIB (BsiWI)+NdeI sites. The resulting plasmid (pS206-1309) is then digested with Fse+EcoRV, and the ~1924 bp Fse-end fragment of wild-type SAdV-A1309 sequence (SEQ ID NO: 86) is cloned therein resulting in the pS207-A1309 plasmid. pS207-A1309 is digested with Fse and the ~17,731 bp Fse-Fse fragment of wild-type SAdV-A1309 sequence (SEQ ID NO: 86) is cloned therein resulting in the pS208-A1309 plasmid. pS208 is digested with Spe and the ~24,718 bp Spe-Spe fragment of wild-type SAdV-A1309 sequence (SEQ ID NO: 86) is cloned therein resulting in the pS209-A1309 plasmid.

A suitable transgene expression cassette is then introduced into the pS209-A1309. The transgene may be, e.g., a reporter such as eGFP, an influenza A nucleoprotein, or HIV-gag (e.g., from pSh-HIV-short-gag (SEQ ID NO: 319)) via the I-CeuI and PI-SceI sites of the meganuclease cassette. Additional transgenes described herein and known in the art may be used consistent with this example and the skill in the art and are contemplated hereby.

A proposed E1 deleted SAdV-A1309 vector containing an HIV-gag transgene is identified in SEQ ID NO: 246.

E. SAdV-A1316

An E1 deleted SAdV-A1316 vector is prepared by digesting the pSR7 plasmid (SEQ ID NO: 323) with SnaBI+NheI, and the wild-type SAdV-A1316 sequence (SEQ ID NO: 114) with NheI to produce an ~3032 bp fragment for incorporation into the plasmid. The resulting plasmid (pS210-A1316) is digested with NsiWI+NedI or with SnaBI+NdeI and ICeuPI-SceI meganuclease cassette(s) (SEQ ID NO: 326) cloned therein via SnaIB (BsiWI)+NdeI sites. The resulting plasmid (pS211-A1316) was digested with NheI+EcoRV and the ~771 bp Nhe digested fragment of the wild-type SAdV-A1316 sequence (SEQ ID NO: 114) cloned in. Similarly, the resulting plasmid pS212-A1316 is digested with NheI and the ~32845 bp Nhe digested fragment of the wild-type SAdV-A1316 sequence (SEQ ID NO: 114) cloned in (resulting in pS213-A1316).

A suitable transgene expression cassette is then introduced into the pS213-A1306 plasmid. The transgene may be, e.g., a reporter such as eGFP, an influenza A nucleoprotein, or HIV-gag (e.g., from pSh-HIV-short-gag (SEQ ID NO: 319)) via the I-CeuI and PI-SceI sites of the meganuclease cassette. Additional transgenes described herein and known in the art may be used consistent with this example and the skill in the art and are contemplated hereby.

A proposed E1 deleted SAdV-A1316 vector containing an HIV-gag transgene is identified in SEQ ID NO: 272.

F. SAdV-A1322

A proposed E1 deleted SAdV-A1322 vector containing an HIV-gag transgene is identified in SEQ ID NO: 295, and may be prepared according as indicated above by one of ordinary skill in the art. [An L1 IIIa region is contained at nt 12273-13776, which is not codable within the Sequence Listing.]

EXAMPLE 5

T-Cell Induction

The protocols contained in Roy, et al. ["Partial protection against H5N1 influenza in mice with a single dose of a chimpanzee adenovirus vector expressing nucleoprotein", *Vaccine* 25:6845-6851 (Aug. 6, 2007)], which is herein incorporated by reference, may be utilized to assess T cell induction by the resulting recombinant adenovirus virus.

EXAMPLE 6

Cytokine Induction

Characterization of cytokine responses to adenoviral vectors described here is performed according to the methods of Lin, et al., *J Virol.* 2007 November; 81(21): 11840-11849 (Vaccines Based on Novel Adeno-Associated Virus Vectors Elicit Aberrant CD8+ T-Cell Responses in Mice), and Lin, et al., *Hum. Gene Ther.* 2008 July; 19(7): 663-669 (Impact of Preexisting Vector Immunity on the Efficacy of Adeno-Associated Virus-Based HIV-1 Gag Vaccines), including Enzyme-linked immunosorbent assay, Interferon-γ enzyme-linked immunospot assay, and Intracellular cytokine staining (ICCS).

Characterization is expected to reflect an advantageous cytokine profile following vector administration.

All documents recited above, the Sequence Listing, and the entirety of International Patent Application No. PCT/US2011/061632 and U.S. Provisional Patent Application Nos. 61/416,499, 61/416,515, 61/416,467, 61/416,481, 61/416,491, and 61/416,509 (all filed Nov. 23, 2010) are incorporated herein by reference. Numerous modifications and variations are included in the scope of the above-identified specification and are expected to be obvious to one of skill in the art. Such modifications and alterations to the compositions and processes, such as selections of different minigenes or selection or dosage of the vectors or immune modulators are believed to be within the scope of the claims appended hereto.

3. The adenovirus according to claim 1, wherein said adenovirus lacks all or a part of the E1 gene.

4. The adenovirus according to claim 3, wherein said adenovirus is replication—defective.

5. The adenovirus according to claim 1, wherein said capsid is a hybrid capsid.

6. The adenovirus according to claim 5, wherein said hybrid capsid comprises at least one capsid protein from an adenovirus selected from SAdV-A1321, SAdV-A1325, SAdV-A1316, and SAdV-1322.

7. A composition comprising the adenovirus according to claim 1 in a pharmaceutically acceptable carrier.

8. A composition comprising the adenovirus according to claim 1, said adenovirus further comprising at least one simian adenovirus protein selected from the group consisting of:
 E1a, SEQ ID NO: 113;
 E1b, small T/19K, SEQ ID NO: 87;
 E1b, large T/55K, SEQ ID NO: 108;
 IX, SEQ ID NO: 88;
 52/55D, SEQ ID NO: 89;
 IIIa, SEQ ID NO: 90;
 Penton, SEQ ID NO: 91;
 VII, SEQ ID NO: 92;
 V, SEQ ID NO: 93;
 pX, SEQ ID NO: 94;
 VI, SEQ ID NO: 95;
 Endoprotease, SEQ ID NO: 97;
 100 kD, SEQ ID NO: 98;
 22 kD, SEQ ID NO: 109;
 VIII, SEQ ID NO: 99;
 E3/12.5 K, SEQ ID NO: 100;
 CR1-alpha SEQ ID NO: 110;
 gp19K, SEQ ID NO: 101;
 CR1-beta, SEQ ID NO: 102;
 CR1-gamma, SEQ ID NO: 103;
 CR1-delta, SEQ ID NO: 104;
 RID-beta, SEQ ID NO: 105; and
 E3/14.7K, SEQ ID NO: 111.

---

SEQUENCE LISTING (326 sequences)

SEQ ID NO: 1 - DNA, 36546 bp, Unknown
  Simian adenovirus A1321
  repeat_region (1)..(129): ITR
  CDS (1601)..(2155): E1b\19K
  CDS (3484)..(3909): pIX
  misc_feature (3974)..(5595): IVa2    complement (3974..5304,5583..5595)
  misc_feature (5077)..(13837): pol    complement (5077..8655,13829..13837)
  misc_feature (8457)..(13837): pTP    complement (8457..10385,13829..13837)
  CDS (12025)..(13800): pIIIa
  CDS (13885)..(15504): penton
  CDS (15511)..(16089): pVII
  CDS (16134)..(17147): V
  CDS (17174)..(17404): pX
  CDS (17439)..(18200): pVI
  CDS (18309)..(21134): hexon
  CDS (21161)..(21781): protease
  misc_feature (21862)..(23391): DBP   complement (21862..23391)
  CDS (23420)..(25828): 100K
  CDS (26453)..(27133): pVIII
  CDS (27411)..(28046): E3\CR1-alpha
  CDS (28591)..(29193): E3\CR1-beta
  CDS (29209)..(29823): E3\CR1-gamma
  CDS (30748)..(31020): E3\RID-alpha
  CDS (31029)..(31457): E3\RID-beta
  CDS (32117)..(33451): fiber
  misc_feature (33550)..(34697): E4\orf6/7    complement (33550..33801,34524..34697)
  misc_feature (33801)..(34697): E4\orf6    complement (33801..34697)
  misc_feature (34790)..(35131): E4\orf4    complement (34790..35131)
  misc_feature (34980)..(35330): E4\orf3    complement (34980..35330)
  misc_feature (35330)..(35716): E4\orf2    complement (35330..35716)
  misc_feature (35769)..(36140): E4\orf1    complement (35769..36140)
  repeat_region (36418)..(36546): ITR   complement (36418..36546)
catcatcaataatatacctcaaacttttggtgcgcgttaatatgcaaatgagctgtttgaatttggggatggggcgttgtgattggacgagggatgagcgaccgttaggggcggggcgagtgacgttttgatgacgtggccgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatgacagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgctagtcagatctacactttgaaagatgaggcacctgagaaacctgcccgaggagaaaatcctcatcgcttccgggaacgagattctggaactggtggtaaatgccatgatgggcgacgaccctccggagccccccaccccatttgaggcaccttcgctacacgatttgtatgatctggaggtggatgtgcccgaggacgaccccaacgaggaggcggtaaatgatttatttagcgatgccgcgctgctagctgccgaggaggcttcgagctctagctcagacagcgactcctcactgcatacccctagacccggcagaggtgagaaaaagatccccgagcttaaaggggaagagatggacttgcgctgctatgaggaatgcttgcccccgagcgatgatgaggacgagcaggcgatccagaacgcagcgagtcagggaatgcaagccgccagagagagctttgcgctggactgcccgcctctgcccggacacggctgtaagtcttgtgaatttcatcgcatgaatactggagataaagctgtgttgtgtgcactttgctatatgagagcttacaaccattgtgtttacagtaagtgtgattaagttgaactttagagggaggcagagagcagggtgactgggcgatgactggtttatttatgtatatatgttctttatataggtcccgtctctgacgcagatgatgagacccccactacagagtccacttcgtcacccccagaaattggcacatctccacctgagaatattgttagaccagttcctgttagagccactgggaggagagcagctgtggaaagtttggatgacttgctacagggtggggatgaacctttggacttgtgtacccggaaacgccccaggcactaagtgccacacatgtgtgtttacttgaggtgatgtcagtatttatagggtgtggagtgcaataaaaaatgtgttgactttaagtgcgtggtttatgactcaggggtggggactgtgggtatataagcaggtgcagacctgtgtggttagctcagagcggcatggagatttggacggtcttggaagattttcacaagactagacagctgctagagaacgcctcgaacggagtctcttacctgtggagattctgcttcggtggcgacctagctaggctagtctacagggccaaacaggattatagtgaacaatttgaggttattttgagagagtgtcctggtctttttgacgctcttaacttgggccatcagtctcactttaaccagaggatttcgagagcccttgactttactactcctggcagaaccactgcagcagtagccttttttgcttttattcttgacaaatggagtcaagaaacccatttcagcagggattaccagctggatttcttagcagtagctttgtggagaacatggaagtgccagcgcctgaatgcaatctccggctacttgccggtacagccgctagacactctgaggatcctgaatctccaggagagtcccagggcacgccaacgtcgccagcagcagcagcaggaggatcaagaagagaacccgagagccggcctggaccctccggcggaggaggaggagtagctgacctgtttcctgaactgcgccgggtgctgactaggtcttcgagtggtcgggagagggggattaagcgggagaggcatgatgagactaatcatagaaatgaactgactgtcagtttgatgagtcgcaagcgcccagaaacagtgtggtggcatgaggtgcagtcgactggcacagatgaggtgtcagtgatgcatgagagattttccctagaacaagtcaagacttgttggttggagcctgaggatgattgggaggtagccatcaggaattatgccaagctggctctcaggccagacaagaagtacaagattactaagctgataaatatcagaaatgcctgctacatttcagggaatggggctgaagtagagatctgtctccaggaaagggtggctttcagatgctgcatgatgaatatgtacccgggagtggtgggcatggatggggtcacctttatgaacatgaggttcaggggagatgggtataatggcacggtctttatggccaataccaagctgacagttcatggctgctccttctttggctttaataacacctgcatcgaggcctggggtcaggttggtgtgaggggctgcagtttttcagccaactggatggggatcgtgggcaggaccaagagcgtgctgtccgtgaagaaatgcttgtttgagaggtgccacctgggggtgatgagcgagggtgaagccagaatccgccactgcgcctctaccgagacgggctgctttgtgctgtgcaagggcaatgctaagatcaagcataatatgatctgtggagcctcggacgagcgcggataccagatgctgacctgcgccggtgggaacagccatatgctggccaccgtgcatgtggcttcccattcccgcaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggatgtgacggaggacctgcgacccgatcatttggtgttgtcctgcaccgggacggagttcggttccagcggggaagaatctgactagagtgagtagtgttctggggcggtggagggcatgcatgagggccagaatgactgaaatctgtgcttttctgtgtgttgcagcagcatgagcggaagcggctcctttgagggaggggtattcagcccttatctgacggggcgtctcccttcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctattacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgcccgcccaggttttccatgcattcatccatgatgatggcgatgggcccgtgggcggcggcctgggcaaagacgtttcgggggtcggacacatcatagttgtggtcctgggtgagatcatcataggccattttaatgaatttggggcggagggtgccggactgggggacaaaggtaccctcgatcccgggggcgtagttcccctcacagatctgcatctcccaggctttgagctcggagggggggatcatgtccacctgcggggctataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgcttcaggctcatccggctggttgaaaaccgctcccgatcggcgccctgcgcgtcggccaggtagcaattgaccatgagttcgtagttgagcgcctcggccgcgtggcctttggcgcggagcttacctttggatgtctgcccacaggcgggacagaggagggacttgagggcgtagagcttgggggcaaggaagacggactcgggggcgtaggcatccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgaaacgaaagcccgggtccaggccagcacgaaggaggccacgtgggacgggtagcggtcgttgtccaccagcgggtccaccttctccagggtatgcaaacacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagtccctcgtccatctggtcagaaaagacgatctttttattgtcgagtttggtggcgaaggagccgtagagggcgttggaaaggagcttggcgatggagcgcatggtctggttcttttccttgtcggcgcgctccttggccgcgatgttgagttgcacgtactcgcgcgccacgcacttccattcggggaagacggtggtcagctcgtcgggcacgattctgacctgccagccccgattatgcagggtgatgaggtccacactggtggccacctcgccgcgcaggggttcattagtccagcagaggcgcccgcccttgcgcgagcagaaggggggcagggggtcgagcatgacctcgtcgggggggtcggcatcgatggtgaagatgccgggcaggaggtcgggatcaaagtagctgatagaagtggccagatcgtccagggaagcttgccattcgcgcacggccagcgcgcgctcgtagggactgaggggcatgccccagggcatggggtgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggtgcgaggagccccgggcccaggttggtgcggctgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgacgaggacgtccagagcgcagtagtcgagggtctcctggatgatgtcatacttgagctgacccttttgtttccacagctcgcggttgagaaggaactcttcgcggtccttccagtactcttcgagggggaacccgtcctgatcggcacggtaagagcctagcatgtagaactggttgacggccttgtaggcgcagcagcccttctccacggggagggcgtaggcctgggcggctttgcgcagggaggtgtgcgtgagggcgaaagtgtccctgaccatgactttgaggaactggtgcttgaagtcgatatcgtcgcagcccccctgctcccagagttggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaaccgtgggcggcccttgacgtggggcagcttcttgagctcttcgtaggtgagctcgtcggggtcgctgagcccgtgctgctcgagcgcccagtcggcgagatgggggttggcgcggaggaaagaagtccagagatccacggccagggcggtttgcaggcggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcagcccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcggctggggcgacgggggcggtgtttccatctcggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaagcgttccatggcctcgtaaaagtccacggcgaagttgaaaaactgggagttacgcgccgagacggtcaactcctcctccagaagacggatgagctcggcgatggtggcgcgcacctcgcgctcgaaggcccccgggagttcctcctcttccatctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctgccgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaactttttggaggccggaaatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcagcagcaacttccagccacgaccgccgcggccgccgtgagcgggactggacagacttctcagtatgaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggacagaaagagggtgctgagggacgaggatttcgaggcggacgagctgacggggatcagccccgcgcgtgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcaacatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccctggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggcgttcaagaacttgcagggcctctggggcgtgcaggccccggtcggggaccgcgcgacggtgtcgagcctgctgacgccgaactcgcgcctgctgttgctgctggtggctcccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggaaatctggaagccaccctgaactttttgctgaccaatcggtcgcagaagatcccgccccagtacgcgctcagcgccgaggaggagcgcatcctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcagccgccatgaactctgactatttcaccaacgccatcctgaatccccactggcttccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaggaggagtacttgaatgactccctgctgagacccgagcgggagaagaacttccccaataacgggatagagagcctggtggacaagatgagccgatggaagacgtatgcgcaggagcacagggacgatccccgggcgtcgcagggggccacgagccggggcagcgccgcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatagcgaccagcgtgcgttcgtttcttctctgttgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaacggggtcaaagtagatgacacgtatgatggtagtcaggatatcttggagtataagtgggtggagtttgagctgcccgaaggcaacttctcggtgaccatgaccatcgacctgatgaacaacgccatcatcgacaattacttggcggtggggcggcagaacggggtcctggagagcgatatcggcgtgaagttcgacactaggaacttcaggctgggctgggaccccgtgaccgagctggtcatgccaggggtgtacaccaacgaggccttccaccccgatattgtcttgctgcccggctgcggggtggacttcaccgagagccgcctcagcaacctgctgggcattcgcaagaggcagcctttccaggaaggtttccagatcatgtacgatgatctggaggggggcaacatccccgcgctcctggatgtcgaggcctatgaggaaagcaaggaaaaagcagaagccgaggcgactgcagccgtggctactgccgcggccaatgcagatgccaatgtgactagaggcgatacattcgccactcaggcggaggaagcagccgccctagcggtcgccgatgatagtgaaagtaagatagttatcaaaccagtaaaagtggatagcaagaacagaagctacaacgtgctgccggacgaggtaaacaccgcctaccgcagttggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttgacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgacgatctggtggagtttgtgcgcgagttcgccccccggcggcgcgtgcagtggcgcgggcggaaggtgcaaccggtgctgagacccggcaccaccgtggttttcacacccggcgagcgctccggcaccgcttccaagcgctcctacgacgaggtgtacggggatgatgatatcctggagcaggcggccgagcgcctgggcgagtttgcttacggcaagcgcagccgccccgcggcgcccccagaagcggtgtccatcccgctggaccacggcaaccccacgccgagcctcaagcccgtgaccctgcagcaggtgctgccgagcgcggcgccgcgccggggcttcaagcgcgagggcgaggatctgtaccccaccatgcagctgatggtgcccaagcgccagaagctggaagacgtgctggagaccatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcggccgctcctagaccccggcgcaagtacggcgcggccagcctgctgatgcccaactacgcgctgcatccttccatcatccccacgccgggctaccgcggcacgcgcttctaccgcgggcagaccacccgccgccgccgcaagaccactcgccgccgccgtcgccgcacagccgctgcaacttccgccgccgccctggtgcggagagtgtaccgccgcggccgcgcgcctctgaccctgccgcgcgcgcgctaccacccgagcatcgccatttaaacactttcgcgcctgctttgcagatggccctcacttgccgcattcgcgttcccattgcgggctaccgaggaagaaaaccgcgccgtagaaggctggcggggagcgggatgcgtcgccacccccaccggcggcggcgcgccatcagcaagcggttggggggaggcttcctgcccgcgctgatccccatcatcgccgcggcgatcggggcgatccccggcatcgcttccgtggcggtacaggcctctcagcgccactgagacacttggaacatcttgtaataaaaaaccaatggactctgacgctcctggtcctgtgatgtgttttcgtagacagatggaagacatcaatttttcgtccctggctccgcgacacggcacgcggccgttcatgggcacctggagcgacatcggcaacagccatctgaacgggggcgccttcaattggagcagtctctggagcgggcttaagaatttcgggtccacgcttaaaacctatggccacaaggcgtggaacagcaacacagggcaggcgctgagggaaaagctgaaagagcagaacttccagcagaaggtggtcgatggcctcgcctcgggcatcaacggggtggtggacctggccaaccaggccgtgcagcggcagatcaacagccgactggagccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtgaaactgggcctgcccaccacgcggcccatcgcgcccctggccaccggggtgctgaaacccgagtctaagcccgcgaccctggacttgcctcctcccccgacatcccgcccctccacagtggctaagcccctgccgccggtggcccgcgcgcgacccgggagccgcccgcaggcgaactggcagagcactctgaacagcatcgtgggtctgggagtgcagagtgtgaagcgccgccgctgctattaaacaacataccgtagcgcttaacttgcttgtctgtgtgtgtatgtattatgtcgccgccgctgtcgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggcccccaagggagctcccaattccagccagtgggagcaagcaaaaacaggcaatgggggaactatggaaacacacacatatggtgtggccccaatgggcggagagaatattacaaaagatggtcttcaaattggaacagatgctacagcggatcagaataaaccaatttatgctgacaaaacattccagccagaaccccaagtaggagaagaaaattggcaagaaactgaaagcttttatggtggtagggctcttaaaaaagatacaaacatgaaaccttgctacggctcctatgctagacccactaatgaaaagggaggacaagctaaacttaaagttggagatgatggagttccaaccaaagaatttgatatagacctggctttctttgatactcccggtggtactgtgaatggccaagatgagtataaagcagacattgtcatgtataccgaaaacgcgtatctggaaactccagacacacatgtggtatacaaaccaggcaaggaagatgcaagttctgaaattaacctggttcagcagtccatgcccaacaggcccaactacattgggttcagagacaactttattggtctcatgtactacaacagcactggcaacatgggggtgctggctggtcaggcctcacagttgaatgctgtggttgacttgcaagacagaaacactgaactgtcctaccagctcttgcttgactctctgggtgacagaaccaggtatttcagtatgtggaatcaggcggtggatagctatgaccctgatgtgcgcatcattgaaaaccatggtgtggaggatgaattgccaaactattgcttccccttggatgggtccggcactaacgccgcttaccaaggtgtaaaagtaaaaaatggtgaagatggtgatcttgagagcgagtgggaaaatgatgatactgtggcagctcgaaatcaattatgtaaaggcaacatttttgccatggaaatcaacctccaagccaacctgtggaggagtttcctctactcgaacgtggccctgtacctgcccgattcttacaagtacacgccggccaacatcactctgcccaccaacaccaacacctacgattacatgaatgggagagtggtgcctccctcgctggtggacgcctacatcaacatcggggcgcgctggtcgctggaccccatggacaacgtgaaccccttcaaccaccaccgcaacgcgggcctgcgctaccgctccatgctcctgggcaacgggcgctacgtgcccttccacatccaggtgccccagaagttcttcgccatcaagagcctcctgctcctgcccgggtcctacacctacgagtggaacttccgcaaggacgtcaacatgatcctgcagagctccctcggcaacgacctgcgcacggacggggcctccatccagttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggctaacgccaccaacgtgcccatctccatcccctcgcgcaactgggccgccttccgcggctggtccttcacgcgcctcaagacccgcgagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgaggggtacaacgtggcccagtgcaacatgaccaaggactggttcctggtccagatgctggcccactacaacatcggctaccagggcttccacgtgcccgagggctacaaggaccgcatgtactccttcttccgcaacttccagcccatgagccgccaggtggtcgacgaggtcaactacaaggactaccaggccgtcaccctggcctaccagcacaacaactcgggcttcgtcggctacctcgcgcccaccatgcgccagggccagccctaccccgccaactacccctacccgctcattggcaagagcgccgtcaccagcgtcacccagaaaaagttcctctgcgaccgcgtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtcagagtgcaccagccccaccgcggcgtcatcgaggccgtctacctgcgcacccccttctcggccggtaacgccaccacctaagctcttgcttcttgcaagcagctatggcctgcgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggagcccaccctgcgccgcaaccaagaggcgctctaccgcttcctcaactcccactccgcctactttcgctcccaccgcgcgcgcatcgagaaggccaccgccttcgaccgcatgaatcaagacatgtaaaccgtgtgtgtatttttatctgtgtctttaataaacagcgcttttatgtgacatgcatctctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgtttcacgctcgccagcaccgtcgcgtcggtgatactctccacgtcaaggtcctcggcgttggccatcccgaagggggtcatcttgcaggtctgccggcccatggtgggcacgcacccgggcttgtggttgcaatcgcagtgcagggggatcagcatcatctgggcctggtcggcgttcatccccgggtacatggccttcatgaacgcctccagctgtctgaaggcctgctgggccttggctccttcggtgaaaaagaccccgcaggacttgctagagaactggttggtagcgcagccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgaccatgtgctccttctggatcatggtgctgccgtgcaggcaccgcagcttgccctcggcctcggtgcacccatgcagccacagcgcgcacccggtgcactcccagttcttgtgggcgatctgggaatgcgagtgcacgaagccctgcaggaagcggcccatcatggtcgtcagggtcttgttgctggtgaaggtcagcgggatgccgcggtgctcctcgttgatgtacaggtggcagatgcggcggtacacctcgccctgctcgggcatcagctggaagttggatttcagctcgctttccacgcggtagcggtccatcagcagagccatgatttccatgcccttctcccaggccgagacgatgggcaggctcatggggttcttcaccatcatcttggagctagccgccgcagccagggggtcgctctcgtccagggtctcaaagctccgcttgccgtccttctcggtgatccgcacgggggggtagctgaagcccacggccgccagctcctcctcggcctgtctttcgtcctcgctgtcctggctgacgtcctgcaggaccacatgcttggtcttgcggggcttcttcttgggcggcagcggcggcggctgttcctgaggcgagggggagcgcgagtgctcgctcaccaccacaatttcttcttcttggtccgaggccacgcggcggtaggtatgtctcttcaggggcagaggcggaggcgacgggctctcctcgcggcccggcgggtggctggcagagccccttccgcgttcgggggtgcgctcccggcggcgctctgactgacttcctccgcggccggccattgtgttctcctagggaacaacaacaagcatggagactcagccatcgtcgccaacctcgccatctgcccccaccaccgccgacgagaagcagcagcagcagaatgaaagcttaaccgccccgccgcccagccccgcctccgacgcggccgcggtcccagacatgcaagagatggaggaatccatcgagattgacctgggctatgtgacgcccgcggagcacgaggaggagctggcagtgcgcttttcatcgagccaggaagaaaaagaacagcagccagaacaggaagcagagagcgagcagagtcaggctgggctcgagcatggcgactacctccacctgagcgggggggaggacgcgctcatcaagcatctggcccggcaggccctcatcgtcaaggacgcgctgctcgaccgcatcgaggtgcccctcagcgtggaggagctcagccgcgcctacgagctgaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgccctcttcaacctgggccccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcccgcttggcggtgctcaagcgcacggtcgagctgacccatttcgcctacccggccctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctacccctcagagtttggaagagcggcgcaagctcatgatggccgtggtcctggtgaccgtggagctggagtgcttgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcaacgagcgaaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcttgcaacccccagctgctgagcgagacccagatcatcggcaccttcgagttgcaagggcccagcgatgagggttcagccaaggggagtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaacttcccccgcaacatcttgcattactaccgtcacctccacagcccctactacttccaagaagaggcaacagcagcagaaaaagaccagaaaaccagcagcagctagaaaatccacagcggcaggtggactgaggatcgcagcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagccgcagaaaaaggcgggaattacgtcacctgtgcccttcgccctagccgcctccacccatcatcatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaaatcgccggatcggggagatcttccttcacgcctcgtcaggcggtcctgaccttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcagtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagccagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccggtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttcagacccttcctccccggcacctatcagtgcatctcgggaccctgccatcacaccttccacctgatcccgaataccaccacctcttccccagcgccgctccccactaacaaccaaactaaccaccaccaacgccaccgtcgagacctcgttgaatctaataccacccacaccggaggtgagctccgaggtcctgaatcctctgggatttattacggcccctgggaggtggtggggttaatagctttaggcttagtagcgggtgggcttttggctctctgctacctatacctcccttgcttttcctacttagtggtgctttgttgctggtttaagaaatggggaagatcaccctagtgtgcggtgtgctggtgacggtggtgctttcgattctgggagggggaagcgcggctgtagtgacggagaagaaggccgatccctgcttgactttcaaccccgataactgccggctgagttttcagccagatggcaatcggtgtgcggtgttgatcaagtgcggatgggaatgcgagagcgtggtgatccagtataaaaacaaaacctggaacaatactctcgcgtccacatggcagcccggggaccccgagtggtacaccgtctctgtccctggtgctgacggctccctccgcacggtgaacaacactttcatttttgagcacatgtgcgaaaccgccatgttcatgagcaagcagtacggtatgtggcccccacggaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacacacttttttcacacactttttcagaccatggcctctgttacttttttgataattgccagtctcattgctgttataagtaatgagaaactcactgtttacattggtactaatcacacactagaaggaattccaaaatcctcatggtattgctattttgatcaaaatccagagctaactgtagaattatgtggtaacagtggaaaaaataaaagcattcatttaattaactttgggtgcggaaaagatttgatactaattaatatcactagagagtatgcaggtatgtactactacgccacagaaggcatttcaaacatgcaattttatgaagttactgtgtctgaacctaccacgcctaaaatgaccacaaccacaaagactacagttgtcagcactatacatctcagtaccaatggcatttttgctatgcttcagatggccaataacagcaccagcatgccacacacacctacactacctagtgaggaaatacctaaatccatggtcgccatcatagctgctgtagtggtgtgtatgctgattattgttttgtgcatggcctactacgcttgctactacagaaggcacagactaagcgacaagctggaccaattactgagtgttgaattttaattttttagaaccatgaagatcctagccctttttgttttatctataattacatctgctctatgcaattctgacaatgaggatgttactgtcattgtcggatccaattacacactaaaaggcccaaccgagggtatgctttcgtggtattgctattttggaactgatactaagcaaacagagctctgtaatgctatgaaaggtcagatgcctacttccagaattaaacataaatgtaatggtactgacctaatactactcaatatcacaaaagcatatgctggcagttattcctgccctgcggccaacactgaggatatgattttttacaaagtaactgttgttgatcccaccactccaccaccacccaccacaactactaaagctaccacacacacacagcaaaccacaccagataaggggtttgccttaaaagttcagcaagaaggcggggcttcttttggagctaagacccctactcctgatcctcactgtccagggccattagtcagcagcattgtcggtgtgctttgtggtttagcaattgtgatcatctgcttgttcatttttgcttgctgctacagaaggcttcaccgacaaaaatcagacccactgctgaacctctatgtttaattttaatttcagaaccatgaaggcacttatcactttagtttttctttctttaattggcactgtttttagtgttagttttttgaaaaaaatcaatgtcactgagggagataatgtgacattggttggtgtagaaggtgctgaaaataccacctggacaaaatatcacatggatgggtggaaagaaatttgcacctggaatgtcactacttatacatgtgagggagttaaccttaccattgtcaatgttagcgaaattcaaaagggttggattaaagggcagagtgttagtgtcaccagtgagggatattttacccaacatacttttatctatgacattattgtcataccactgcccacacctagcccacctagcactactcagaccacacaaacaacctacactacacagagctccacaactaccttgcaaaccactcagacaaccacttacactacatccactcagcccaccaccactacagcagaggcgagtagctcaccaaccatcaaagtggcatttttgttactgccaccatctagcagtcctgctagtaccaatgagcagactactgaatttttgtccactattcagagcagcaccacagctacctcgagtgccttctctagcaccgccaatctcacctcgctttcctctacgccaatcagtaatgctactacctccccagctcctcttcccactcctctgaagcaatcagagtctagcacgcagctgcagatcaccctgctcattgtgatcggggtggtcatcctggcagtgctgctctactttatcttctgccgccgcatccccaacgcgaagccggcctacaagcccattgttatcggcacgccggagccgcttcaggtggagggaggtctaaggaatcttctcttctcttttacagtatggtgatttgaactatgattcctagacatttcattatcacttctctaatctgtgtgctccaagtctgtgccaccctcgctctcgtggctaacgcgagtccagactgcattggagcgttcgcctcctacgtgctctttgccttcatcacctgcatctgctgctgtagcatagtctgcctgcttatcaccttcttccagttcgttgactgggtctttgtgcgcatcgcctacctgcgccaccatccccagtaccgcgaccagagagtggcgcaactgttgagactcatctgataagcatgcgggctctgctacttctcgcgcttgtgctagctcccctcgccgcccccttaaccctcaaatcccccacccagtcccctgaagaggttcgaaaatgtaaattccaagaaccctggaaattcctttcatgctacaaactcaaatcagaaatgcaccccagctggatcatgatcattggaatcgtgaacatccttgcctgtaccctcatctcctttgtgatttacccctgctttaactttgggtggaacgcacccgaggcgctctggctcccgcctgatcccgacacaccaccacagcagcagcaaaatcaggcacatgcaccaccacagcctaggccacaatacatgcccatcttagactatgaggccgagccacagcgagccatgcttcctgctattagttacttcaatctaaccggcggagatgactgaccccatggccaacaacaccgtcaacgacctcctggacatggacggccgcgcctcggagcagcgactcgcccaactccgcatccgccagcagcaggagagagccgtcaaggagctgcaggatgcggtggccatccaccagtgcaagaaaggcatcttctgcctggtgaagcaggccaagatcaccttcgaggtgacttccaccgaccatcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccttgatcaagaccctctgcggcctccgcgacctcctccccatgaactaatcaactaacccctacccctttaccctccagtaaaaataaagattaaaaagagatgatgatgatttgaattgatcaataaagaatcacttacttgaaatctgaaaccaggtctctgtccatgttttctgtcagcagcacttcactcccctcttcccagctctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgtctggccgaccccgtcaccaccaagaacggggctgtcaccctcaagctgggggagggggtggacctcgacgactcgggaaaactcatctccaaaaatgccaccaaggccactgcccctctcagtatttccaacaacaccatttcccttaacatggatacccctttttacaacaacaacggaacgctaggcatgaaggtaactgcaccactaaagatcttagacacaaatctactaaaaacacttgttgttgcttatgggcagggattaggaacaagcaccactggtgctcttgttgctcaactagcatacccacttgtttttaataccgataacaaaattgcccttaatttaggcaatggaccattaaaagtggatgcaaataaactgaacattaattgcaaaagaggtctctatgtcacccccacaaaagatgcactggagattaatatcagttgggcaaatgctatgacatttataggaaatgccattggtgtaaatattgacacaaaaaaaggcctacagtacggcacttcaagcactgaaacagatgttaaaaatgcttttccactccaagtaaaacttggagctggtcttacatttgacagcacaggtgccattgttgcttggaacaaagatgatgataaacttacactatggaccatggctgacccatctccaaactgtcacatatattctgaaaaggatgctaagcttacactctgcttaacaaagtgtggcagtcagatactgggcactgtttccctactggctgtcgacaatggaagcttaaacccaataacaggaaaagtaaccacagctcttgtttcgctgaaatttgatgccaatggagttttgcaagacagttcgacacttgacaaagactattggaatttcagacaaggtgatgctacacctgctgaaccctataccaatgctataggttttatgcccaatctaaaagcatacccaaaaaacacaaatggagctgcaaaaagtcatattgttggaaaagtataccttcatggtgatgtaagcaagccgcttaatctgataattacttttaatgaaaccagtgatgaatcctgtacttattgtattaactttcagtggcagtggggaactgaccaatataaaactgaaacacttgcagtcagttcattcacattctcctacattgccaaggaataaaccctgcatgacaacccattcccaccactgtatctacaatggaaaactctgaagcagaaaaataaagttcaagtgttttattgattcaacagttttcacaggattcgagtagttattttccctcctccctcccaactcatggaatacaccaccctctccccacgcacagccttaaacatctgaatgccattggtaatggacatggttttggtctccacattccacacagtttcagagcgagccagtctcgggtcggtcagggagatgaaaccctccgggcactcctgcatctgcacctcaaagttcagtagctgagggctgtcctcggtggtcgggatcacagttatctggaagaagagcgatgagagtcataatccgcgaacgggatcgggcggttgtggcgcatcaggccccgcagcagtcgctgtctgcgccgctccgtcaagctgctgctcaaggggtccgggtccagggactccctgcgcatgatgccgatggccctaagcatcagtcgcctggtgcggcgggcgcagcagcggatgcggatctcactcaggtcggagcagtatgtgcagcacagcaccaccaagttgttcaacagtccatagttcaacacactccagccaaaactcatctgtggaactatgctgcccacatgtccatcgtaccagatcctgatgtaaatcaggtggcgccccctccagaacacactgcccatgtacatgatctccttgggcatatgcaggttcaccacctcccggtaccacatcacccgctggttaaacatgcagccctggataatcctgcggaaccagatggccagcaccgccccgcccgccatgcagcgcagggaccccgggtcctggcaatggcagtggatgatccaccgctcgcggccgtggatcagctgggagctgaacaagtctatgttggcacagcacaggcacacgctcatgcatgtcttcagcactctcagttcctcgggggtcaagaccatgtcccagggcacggggaactcttgcaggacagtgaacccggcagaacagggcaaccctcgcacacaacttacattgtgcatggacagggtatcgcaatcaggcagcaccggatgatcctccaccagagaagcacgggtctcggtctcctcacagcgaggtaaggggaccggcggttggtacggatgatggcgggatgacgctaatcgtgttctggatcgtgtcatgatggagctgtttcctgacattttcgtacttcacgaagcagaatctggtccgggcactgcacaccgctcgtcggcgacggtctcggcgcttcgagcgctcggtgttgaagttatagaacagccactccctcagagcgtgcagtatctcctgagcctcttgggtgatgaaaatcccatccgccctgatggctctgatcacatcgaccacggtggaatgggccagacccagccagatgatgcaattttgttgggtttcggtgacggcgggggagggaagaacaggaagaaccatgattaactttattccaaacggtctcggagcacttcaaaatgcaggtcccggaggtggcacctctcgcccccactgtgttggtggaaaataacagccaggtcaaaggtgacacggttctcgagatgttccacggtggcttccagcaaagcctccacgcgcacatccagaaacaagaggacagcgaaagcgggagcgttttctaattcctcaatcatcatattacactcctgcaccatccccagataattttcatttttccagccttgaatgattcgtattagttcctgaggtaaatccaagccagccatgataaaaagctcgcgcagagcgccctccaccggcattcttaagcacaccctcataattccaagagattctgctcctggttcacctgcagcagattaacaatgggaatatcaaaatctctgccgcgatccctaagctcctccctcaacaataactgtatgtaatctttcatatcatctccgaaatttttagccataggaccgccaggaataagagaagggcaagccacattacagataaagcgaagtcctccccagtgagcattgccaaatgtaagattgaaataagcatgctggctagaccctgtgatatcttccagataactggacagaaaatcaggcaagcaatttttaagaaaatcaacaaaagaaaagtcgtctaggtgcacgtttagagcctcaggaacaacgatggaataagtgcaaggagtgcgttccagcatggttagtgtttttttggcgatctgtagaacaaaaaataaacatgcaatattaaaccatgctagcctggcgaacaggtggataaatcactctttccagcaccaggcaagctacggggtctccggcacgaccctcgtagaaactgtcaccgtgattgaaaagcatcaccgaaagagtctcccggtggccggcatggatgattcgagaagaagcatacactccgggaacattggcgtccgtgagtgaaaaaaagcgacccaggaagccccgaggcactacaatgctcaatctcagttccagcagggcgaccccatgcggatgaagcacaaaattggcaggtgcgtaaaaaatgtaattactcccctcctgcacaggcagcaaagcccccgctccctccagaaacacatacaaagcctcagcgtccatagcttaccgagcacggcaggcgcaagagtcagagaaaaggctgagctctaacctgactgcccgctcctgagctcaatatatagccctaacctacactgacgtaaaggccaaagtctaaaaatacccgccaaaatgacacacacgcccagcacacgcccagaaaccggtgacacactcaaaaaaatacgtgcgcttcctcaaacgcccaaaccagcgtcatttccgggttcccacgctacgtcaccgctcagcgactttcaaattccgtcgaccgttaaaaacgtcactcgccccgcccctaacggtcgctcatccctcgtccaatcacaacgccccatccccaaattcaaacagctcatttgcatattaacgcgcaccaaaagtttgaggtatattattgatgatg

SEQ ID NO: 2 - protein, 185 aa, Unknown
  Synthetic Construct
MEIWTVLEDFHKTRQLLENASNGVSYLWRFCFGGDLARLVYRAKQDYSEQFEVILRECPGLFDALNLGHQSHFNQRISRALDFTTPGRTTAAVAFFAFILDKWSQETHFSRDYQLDFLAVALWRTWKCQRLNAISGYLPVQPLDTLRILNLQESPRARQRRQQQQQEDQEENPRAGLDPPAEEEE

SEQ ID NO: 3 - protein, 142 aa, Unknown
  Synthetic Construct
MSGSGSFEGGVFSPYLTGRLPSWAGVRQNVMGSTVDGRPVQPANSSTLTYATLSSSSVDAAAAAAAASAASAVRGMAMGAGYYGTLVANSSSTNNPASLNEEKLLLLMAQLEALTQRLGELTQQVAQLQEQTRAAVATVKSK

SEQ ID NO: 4 - protein, 592 aa, Unknown
  Synthetic Construct
MQQQPPPDPAMRAALQSQPSGINSSDDWTQAMQRIMALTTRNPEAFRQQPQANRLSAILEAVVPSRSNPTHEKVLAIVNALVENKAIRGDEAGLVYNALLERVARYNSTNVQTNLDRMVTDVREAVAQRERFHRESNLGSLVALNAFLSTQPANVPRGQEDYTNFISALRLMVTEVPQSEVYQSGPDYFFQTSRQGLQTVNLSQAFKNLQGLWGVQAPVGDRATVSSLLTPNSRLLLLLVAPFTDSGSINRNSYLGYLINLYREAIGQAHVDEQTYQEITHVSRALGQDDPGNLEATLNFLLTNRSQKIPPQYALSAEEERILRYVQQSVGLFLMQEGATPSAALDMTARNMEPSMYASNRPFINKLMDYLHRAAAMNSDYFTNAILNPHWLPPPGFYTGEYDMPDPNDGFLWDDVDSSVFSPRPGANERPLWKKEGSDRRPSSALSGREGAAAAVPEAASPFPSLPFSLNSIRSSELGRITRPRLLGEEEYLNDSLLRPEREKNFPNNGIESLVDKMSRWKTYAQEHRDDPRASQGATSRGSAARKRRWHDRQRGLMWDDEDSADDSSVLDLGGSGGNPFAHLRPRIGRMM

SEQ ID NO: 5 - protein, 540 aa, Unknown
  Synthetic Construct
MMRRAYPEGPPPSYESVMQQAMAAAMQPPLEAPYVPPRYLAPTEGRNSIRYSELAPLYDTTRLYLVDNKSADIASLNYQNDHSNFLTTVVQNNDFTPTEASTQTINFDERSRWGGQLKTIMHTNMPNVNEFMYSNKFKARVMVSRKTPNGVKVDDTYDGSQDILEYKWVEFELPEGNFSVTMTIDLMNNAIIDNYLAVGRQNGVLESDIGVKFDTRNFRLGWDPVTELVMPGVYTNEAFHPDIVLLPGCGVDFTESRLSNLLGIRKRQPFQEGFQIMYDDLEGGNIPALLDVEAYEESKEKAEAEATAAVATAAANADANVTRGDTFATQAEEAAALAVADDSESKIVIKPVKVDSKNRSYNVLPDEVNTAYRSWYLAYNYGDPEKGVRSWTLLTTSDVTCGVEQVYWSLPDMMQDPVTFRSTRQVSNYPVVGAELLPVYSKSFFNEQAVYSQQLRAFTSLTHVFNRFPENQILVRPPAPTITTVSENVPALTDHGTLPLRSSIRGVQRVTVTDARRRTCPYVYKALGIVAPRVLSSRTF

SEQ ID NO: 6 - protein, 193 aa, Unknown
  Synthetic Construct
MSILISPSNNTGWGLRAPSKMYGGARQRSTQHPVRVRGHFRAPWGALKGRVRSRTTVDDVIDQVVADARNYTPAAAPVSTVDAVIDSVVADARRYARAKSRRRRIARRHRSTPAMRAARALLRRARRTGRRAMLRAARRAASGASAGRTRRRAATAAAAAIASMSRPRRGNVYWVRDAATGVRVPVRTRPPRT

SEQ ID NO: 7 - protein, 338 aa, Unknown
  Synthetic Construct
MSKRKFKEEMLQVIAPEIYGPAAVVKEERKPRKIKRVKKDKKEEDDDLVEFVREFAPRRRVQWRGRKVQPVLRPGTTVVFTPGERSGTASKRSYDEVYGDDDILEQAAERLGEFAYGKRSRPAAPPEAVSIPLDHGNPTPSLKPVTLQQVLPSAAPRRGFKREGEDLYPTMQLMVPKRQKLEDVLETMKVDPEVQPEVKVRPIKQVAPGLGVQTVDIKIPTEPMETQTEPVKPSTSTMEVQTDPWMPAAAPRPRRKYGAASLLMPNYALHPSIIPTPGYRGTRFYRGQTTRRRRKTTRRRRRRTAAATSAAALVRRVYRRGRAPLTLPRARYHPSIAI

SEQ ID NO: 8 - protein, 77 aa, Unknown
  Synthetic Construct
MALTCRIRVPIAGYRGRKPRRRRLAGSGMRRHPHRRRRAISKRLGGGFLPALIPIIAAAIGAIPGIASVAVQASQRH

SEQ ID NO: 9 - protein, 254 aa, Unknown
  Synthetic Construct
MDSDAPGPVMCFRRQMEDINFSSLAPRHGTRPFMGTWSDIGNSHLNGGAFNWSSLWSGLKNFGSTLKTYGHKAWNSNTGQALREKLKEQNFQQKVVDGLASGINGVVDLANQAVQRQINSRLEPVPPAGSVEMPQVEEELPPLDKRGEKRPRPDAEETLLTHTDEPPPYEEAVKLGLPTTRPIAPLATGVLKPESKPATLDLPPPPTSRPSTVAKPLPPVARARPGSRPQANWQSTLNSIVGLGVQSVKRRRCY

SEQ ID NO: 10 - protein, 942 aa, Unknown
  Synthetic Construct
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNSSQWEQAKTGNGGTMETHTYGVAPMGGENITKDGLQIGTDATADQNKPIYADKTFQPEPQVGEENWQETESFYGGRALKKDTNMKPCYGSYARPTNEKGGQAKLKVGDDGVPTKEFDIDLAFFDTPGGTVNGQDEYKADIVMYTENAYLETPDTHVVYKPGKEDASSEINLVQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGSGTNAAYQGVKVKNGEDGDLESEWENDDTVAARNQLCKGNIFAMEINLQANLWRSFLYSNVALYLPDSYKYTPANITLPTNTNTYDYMNGRVVPPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASIQFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFHVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 11 - protein, 207 aa, Unknown
  Synthetic Construct
MACAGSGEQELRAIIRDLGCGPYFLGTFDKRFPGFMAPHKLACAIVNTAGRETGGEHWLAFAWNPRSNTCYLFDPFGFSDERLKQIYQFEYEGLLRRSALATEDRCVTLEKSTQTVQGPRSAACGLFCCMFLHAFVHWPDRPMDKNPTMNLLTGVPNGMLQSPQVEPTLRRNQEALYRFLNSHSAYFRSHRARIEKATAFDRMNQDM

SEQ ID NO: 12 - protein, 803 aa, Unknown
  Synthetic Construct
METQPSSPTSPSAPTTADEKQQQQNESLTAPPPSPASDAAAVPDMQEMEESIEIDLGYVTPAEHEEELAVRFSSSQEEKEQQPEQEAESEQSQAGLEHGDYLHLSGGEDALIKHLARQALIVKDALLDRIEVPLSVEELSRAYELNLFSPRVPPKRQPNGTCEPNPRLNFYPVFAVPEALATYHIFFKNQKIPVSCRANRTRADALFNLGPGARLPDIASLEEVPKIFEGLGSDETRAANALQGEGGEHEHHSALVELEGDNARLAVLKRTVELTHFAYPALNLPPKVMSAVMDQVLIKRASPISEDEGMQDSEEGKPVVSDEQLARWLGPNATPQSLEERRKLMMAVVLVTVELECLRRFFADAETLRKVEENLHYLFRHGFVRQACKISNVELTNLVSYMGILHENRLGQNVLHTTLRGEARRDYIRDCVYLYLCHTWQTGMGVWQQCLEEQNLKELCKLLQKNLKGLWTGFNERTTASDLADLIFPERLRLTLRNGLPDFMSQSMLQNFRSFILERSGILPATCSALPSDFVPLTFRECPPPLWSHCYLLRLANYLAYHSDVIEDVSGEGLLECHCRCNLCTPHRSLACNPQLLSETQIIGTFELQGPSDEGSAKGSLKLTPGLWTSAYLRKFVPEDYHPFEIRFYEDQSQPPKAELSACVITQGAILAQLQAIQKSRQEFLLKKGRGVYLDPQTGEELNPGFPQDAPRKQEAESGAAARGGFGGRLGEQQSGRGGGDGGRLGQHSGRGGQPARQSGGRRGGGRGGGGRSSRRQTVVLGGESKQHGYHLRSGSGSRSTPQ

SEQ ID NO: 13 - protein, 227 aa, Unknown
  Synthetic Construct
MSKEIPTPYMWSYQPQMGLAAGAAQDYSTRMNWLSAGPAMISRVNDIRAHRNQILLEQSALTATPRNHLNPRNWPAALVYQEIPQPTTVLLPRDAQAEVQLTNSGVQLAGGATLCRHRPAQGIKRLVIRGRGTQLNDEVVSSSLGLRPDGVFQIAGSGRSSFTPRQAVLTLESSSSQPRSGGIGTLQFVEEFTPSVYFNPFSGSPGHYPDEFIPNFDAISESVDGYD

SEQ ID NO: 14 - protein, 212 aa, Unknown
  Synthetic Construct
MKVFVVCCVLSIIKAEISDYSGLNCGVSASINRSLTFTGNETELQLQCKPHKKYLTWLYQGSPIAVVNHCDDDGVLLNGPANLTFSTRRSKLLLFRPFLPGTYQCISGPCHHTFHLIPNTTTSSPAPLPTNNQTNHHQRHRRDLVESNTTHTGGELRGPESSGIYYGPWEVVGLIALGLVAGGLLALCYLYLPCFSYLVVLCCWFKKWGRSP

SEQ ID NO: 15 - protein, 201 aa, Unknown
  Synthetic Construct
MASVTFLIIASLIAVISNEKLTVYIGTNHTLEGIPKSSWYCYFDQNPELTVELCGNSGKNKSIHLINFGCGKDLILINITREYAGMYYYATEGISNMQFYEVTVSEPTTPKMTTTTKTTVVSTIHLSTNGIFAMLQMANNSTSMPHTPTLPSEEIPKSMVAIIAAVVVCMLIIVLCMAYYACYYRRHRLSDKLDQLLSVEF

SEQ ID NO: 16 - protein, 205 aa, Unknown
  Synthetic Construct
MKILALFVLSIITSALCNSDNEDVTVIVGSNYTLKGPTEGMLSWYCYFGTDTKQTELCNAMKGQMPTSRIKHKCNGTDLILLNITKAYAGSYSCPAANTEDMIFYKVTVVDPTTPPPPTTTTKATTHTQQTTPDKGFALKVQQEGGASFGAKTPTPDPHCPGPLVSSIVGVLCGLAIVIICLFIFACCYRRLHRQKSDPLLNLYV

SEQ ID NO: 17 - protein, 91 aa, Unknown
  Synthetic Construct
MIPRHFIITSLICVLQVCATLALVANASPDCIGAFASYVLFAFITCICCCSIVCLLITFFQFVDWVFVRIAYLRHHPQYRDQRVAQLLRLI

SEQ ID NO: 18 - protein, 143 aa, Unknown
  Synthetic Construct
MRALLLLALVLAPLAAPLTLKSPTQSPEEVRKCKFQEPWKFLSCYKLKSEMHPSWIMIIGIVNILACTLISFVIYPCFNFGWNAPEALWLPPDPDTPPQQQQNQAHAPPQPRPQYMPILDYEAEPQRAMLPAISYFNLTGGDD

SEQ ID NO: 19 - protein, 445 aa, Unknown
  Synthetic Construct
MSKKRARVDDGFDPVYPYDADNAPTVPFINPPFVSSDGFQEKPLGVLSLRLADPVTTKNGAVTLKLGEGVDLDDSGKLISKNATKATAPLSISNNTISLNMDTPFYNNNGTLGMKVTAPLKILDTNLLKTLVVAYGQGLGTSTTGALVAQLAYPLVFNTDNKIALNLGNGPLKVDANKLNINCKRGLYVTPTKDALEINISWANAMTFIGNAIGVNIDTKKGLQYGTSSTETDVKNAFPLQVKLGAGLTFDSTGAIVAWNKDDDKLTLWTMADPSPNCHIYSEKDAKLTLCLTKCGSQILGTVSLLAVDNGSLNPITGKVTTALVSLKFDANGVLQDSSTLDKDYWNFRQGDATPAEPYTNAIGFMPNLKAYPKNTNGAAKSHIVGKVYLHGDVSKPLNLIITFNETSDESCTYCINFQWQWGTDQYKTETLAVSSFTFSYIAKE

SEQ ID NO: 20 - DNA, 29960 bp, Unknown
  Simian adenovirus A1321
  CDS (6)..(1496): E1b\55K
  CDS (23645)..(24205): 22K
  CDS (26131)..(26658): E3\gp19K
  CDS (27919)..(28836): E3\CR1-delta
  CDS (29553)..(29954): E3\14.7K
gacaaatggagtcaagaaacccatttcagcagggattaccagctggatttcttagcagtagctttgtggagaacatggaagtgccagcgcctgaatgcaatctccggctacttgccggtacagccgctagacactctgaggatcctgaatctccaggagagtcccagggcacgccaacgtcgccagcagcagcagcaggaggatcaagaagagaacccgagagccggcctggaccctccggcggaggaggaggagtagctgacctgtttcctgaactgcgccgggtgctgactaggtcttcgagtggtcgggagagggggattaagcgggagaggcatgatgagactaatcatagaaatgaactgactgtcagtttgatgagtcgcaagcgcccagaaacagtgtggtggcatgaggtgcagtcgactggcacagatgaggtgtcagtgatgcatgagagattttccctagaacaagtcaagacttgttggttggagcctgaggatgattgggaggtagccatcaggaattatgccaagctggctctcaggccagacaagaagtacaagattactaagctgataaatatcagaaatgcctgctacatttcagggaatggggctgaagtagagatctgtctccaggaaagggtggctttcagatgctgcatgatgaatatgtacccgggagtggtgggcatggatggggtcacctttatgaacatgaggttcaggggagatgggtataatggcacggtctttatggccaataccaagctgacagttcatggctgctccttctttggctttaataacacctgcatcgaggcctggggtcaggttggtgtgaggggctgcagtttttcagccaactggatggggatcgtgggcaggaccaagagcgtgctgtccgtgaagaaatgcttgtttgagaggtgccacctgggggtgatgagcgagggtgaagccagaatccgccactgcgcctctaccgagacgggctgctttgtgctgtgcaagggcaatgctaagatcaagcataatatgatctgtggagcctcggacgagcgcggataccagatgctgacctgcgccggtgggaacagccatatgctggccaccgtgcatgtggcttcccattcccgcaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggatgtgacggaggacctgcgacccgatcatttggtgttgtcctgcaccgggacggagttcggttccagcggggaagaatctgactagagtgagtagtgttctggggcggtggagggcatgcatgagggccagaatgactgaaatctgtgcttttctgtgtgttgcagcagcatgagcggaagcggctcctttgagggaggggtattcagcccttatctgacggggcgtctcccttcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctattacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgcccgcccaggttttccatgcattcatccatgatgatggcgatgggcccgtgggcggcggcctgggcaaagacgtttcgggggtcggacacatcatagttgtggtcctgggtgagatcatcataggccattttaatgaatttggggcggagggtgccggactgggggacaaaggtaccctcgatcccgggggcgtagttcccctcacagatctgcatctcccaggctttgagctcggagggggggatcatgtccacctgcggggctataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgcttcaggctcatccggctggttgaaaaccgctcccgatcggcgccctgcgcgtcggccaggtagcaattgaccatgagttcgtagttgagcgcctcggccgcgtggcctttggcgcggagcttacctttggatgtctgcccacaggcgggacagaggagggacttgagggcgtagagcttgggggcaaggaagacggactcgggggcgtaggcatccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgaaacgaaagcccgggtccaggccagcacgaaggaggccacgtgggacgggtagcggtcgttgtccaccagcgggtccaccttctccagggtatgcaaacacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagtccctcgtccatctggtcagaaaagacgatctttttattgtcgagtttggtggcgaaggagccgtagagggcgttggaaaggagcttggcgatggagcgcatggtctggttcttttccttgtcggcgcgctccttggccgcgatgttgagttgcacgtactcgcgcgccacgcacttccattcggggaagacggtggtcagctcgtcgggcacgattctgacctgccagccccgattatgcagggtgatgaggtccacactggtggccacctcgccgcgcaggggttcattagtccagcagaggcgcccgcccttgcgcgagcagaaggggggcagggggtcgagcatgacctcgtcgggggggtcggcatcgatggtgaagatgccgggcaggaggtcgggatcaaagtagctgatagaagtggccagatcgtccagggaagcttgccattcgcgcacggccagcgcgcgctcgtagggactgaggggcatgccccagggcatggggtgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggtgcgaggagccccgggcccaggttggtgcggctgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgacgaggacgtccagagcgcagtagtcgagggtctcctggatgatgtcatacttgagctgacccttttgtttccacagctcgcggttgagaaggaactcttcgcggtccttccagtactcttcgagggggaacccgtcctgatcggcacggtaagagcctagcatgtagaactggttgacggccttgtaggcgcagcagcccttctccacggggagggcgtaggcctgggcggctttgcgcagggaggtgtgcgtgagggcgaaagtgtccctgaccatgactttgaggaactggtgcttgaagtcgatatcgtcgcagcccccctgctcccagagttggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaaccgtgggcggcccttgacgtggggcagcttcttgagctcttcgtaggtgagctcgtcggggtcgctgagcccgtgctgctcgagcgcccagtcggcgagatgggggttggcgcggaggaaagaagtccagagatccacggccagggcggtttgcaggcggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcagcccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcggctggggcgacgggggcggtgtttccatctcggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaagcgttccatggcctcgtaaaagtccacggcgaagttgaaaaactgggagttacgcgccgagacggtcaactcctcctccagaagacggatgagctcggcgatggtggcgcgcacctcgcgctcgaaggcccccgggagttcctcctcttccatctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctgccgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaactttttggaggccggaaatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcagcagcaacttccagccacgaccgccgcggccgccgtgagcgggactggacagacttctcagtatgaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggacagaaagagggtgctgagggacgaggatttcgaggcggacgagctgacggggatcagccccgcgcgtgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcaacatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccctggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggcgttcaagaacttgcagggcctctggggcgtgcaggccccggtcggggaccgcgcgacggtgtcgagcctgctgacgccgaactcgcgcctgctgttgctgctggtggctcccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggaaatctggaagccaccctgaactttttgctgaccaatcggtcgcagaagatcccgccccagtacgcgctcagcgccgaggaggagcgcatcctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcagccgccatgaactctgactatttcaccaacgccatcctgaatccccactggcttccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaggaggagtacttgaatgactccctgctgagacccgagcgggagaagaacttccccaataacgggatagagagcctggtggacaagatgagccgatggaagacgtatgcgcaggagcacagggacgatccccgggcgtcgcagggggccacgagccggggcagcgccgcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatagcgaccagcgtgcgttcgtttcttctctgttgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaacggggtcaaagtagatgacacgtatgatggtagtcaggatatcttggagtataagtgggtggagtttgagctgcccgaaggcaacttctcggtgaccatgaccatcgacctgatgaacaacgccatcatcgacaattacttggcggtggggcggcagaacggggtcctggagagcgatatcggcgtgaagttcgacactaggaacttcaggctgggctgggaccccgtgaccgagctggtcatgccaggggtgtacaccaacgaggccttccaccccgatattgtcttgctgcccggctgcggggtggacttcaccgagagccgcctcagcaacctgctgggcattcgcaagaggcagcctttccaggaaggtttccagatcatgtacgatgatctggaggggggcaacatccccgcgctcctggatgtcgaggcctatgaggaaagcaaggaaaaagcagaagccgaggcgactgcagccgtggctactgccgcggccaatgcagatgccaatgtgactagaggcgatacattcgccactcaggcggaggaagcagccgccctagcggtcgccgatgatagtgaaagtaagatagttatcaaaccagtaaaagtggatagcaagaacagaagctacaacgtgctgccggacgaggtaaacaccgcctaccgcagttggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttgacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgacgatctggtggagtttgtgcgcgagttcgccccccggcggcgcgtgcagtggcgcgggcggaaggtgcaaccggtgctgagacccggcaccaccgtggttttcacacccggcgagcgctccggcaccgcttccaagcgctcctacgacgaggtgtacggggatgatgatatcctggagcaggcggccgagcgcctgggcgagtttgcttacggcaagcgcagccgccccgcggcgcccccagaagcggtgtccatcccgctggaccacggcaaccccacgccgagcctcaagcccgtgaccctgcagcaggtgctgccgagcgcggcgccgcgccggggcttcaagcgcgagggcgaggatctgtaccccaccatgcagctgatggtgcccaagcgccagaagctggaagacgtgctggagaccatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcggccgctcctagaccccggcgcaagtacggcgcggccagcctgctgatgcccaactacgcgctgcatccttccatcatccccacgccgggctaccgcggcacgcgcttctaccgcgggcagaccacccgccgccgccgcaagaccactcgccgccgccgtcgccgcacagccgctgcaacttccgccgccgccctggtgcggagagtgtaccgccgcggccgcgcgcctctgaccctgccgcgcgcgcgctaccacccgagcatcgccatttaaacactttcgcgcctgctttgcagatggccctcacttgccgcattcgcgttcccattgcgggctaccgaggaagaaaaccgcgccgtagaaggctggcggggagcgggatgcgtcgccacccccaccggcggcggcgcgccatcagcaagcggttggggggaggcttcctgcccgcgctgatccccatcatcgccgcggcgatcggggcgatccccggcatcgcttccgtggcggtacaggcctctcagcgccactgagacacttggaacatcttgtaataaaaaaccaatggactctgacgctcctggtcctgtgatgtgttttcgtagacagatggaagacatcaatttttcgtccctggctccgcgacacggcacgcggccgttcatgggcacctggagcgacatcggcaacagccatctgaacgggggcgccttcaattggagcagtctctggagcgggcttaagaatttcgggtccacgcttaaaacctatggccacaaggcgtggaacagcaacacagggcaggcgctgagggaaaagctgaaagagcagaacttccagcagaaggtggtcgatggcctcgcctcgggcatcaacggggtggtggacctggccaaccaggccgtgcagcggcagatcaacagccgactggagccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtgaaactgggcctgcccaccacgcggcccatcgcgcccctggccaccggggtgctgaaacccgagtctaagcccgcgaccctggacttgcctcctcccccgacatcccgcccctccacagtggctaagcccctgccgccggtggcccgcgcgcgacccgggagccgcccgcaggcgaactggcagagcactctgaacagcatcgtgggtctgggagtgcagagtgtgaagcgccgccgctgctattaaacaacataccgtagcgcttaacttgcttgtctgtgtgtgtatgtattatgtcgccgccgctgtcgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggcccccaagggagctcccaattccagccagtgggagcaagcaaaaacaggcaatgggggaactatggaaacacacacatatggtgtggccccaatgggcggagagaatattacaaaagatggtcttcaaattggaacagatgctacagcggatcagaataaaccaatttatgctgacaaaacattccagccagaaccccaagtaggagaagaaaattggcaagaaactgaaagcttttatggtggtagggctcttaaaaaagatacaaacatgaaaccttgctacggctcctatgctagacccactaatgaaaagggaggacaagctaaacttaaagttggagatgatggagttccaaccaaagaatttgatatagacctggctttctttgatactcccggtggtactgtgaatggccaagatgagtataaagcagacattgtcatgtataccgaaaacgcgtatctggaaactccagacacacatgtggtatacaaaccaggcaaggaagatgcaagttctgaaattaacctggttcagcagtccatgcccaacaggcccaactacattgggttcagagacaactttattggtctcatgtactacaacagcactggcaacatgggggtgctggctggtcaggcctcacagttgaatgctgtggttgacttgcaagacagaaacactgaactgtcctaccagctcttgcttgactctctgggtgacagaaccaggtatttcagtatgtggaatcaggcggtggatagctatgaccctgatgtgcgcatcattgaaaaccatggtgtggaggatgaattgccaaactattgcttccccttggatgggtccggcactaacgccgcttaccaaggtgtaaaagtaaaaaatggtgaagatggtgatcttgagagcgagtgggaaaatgatgatactgtggcagctcgaaatcaattatgtaaaggcaacatttttgccatggaaatcaacctccaagccaacctgtggaggagtttcctctactcgaacgtggccctgtacctgcccgattcttacaagtacacgccggccaacatcactctgcccaccaacaccaacacctacgattacatgaatgggagagtggtgcctccctcgctggtggacgcctacatcaacatcggggcgcgctggtcgctggaccccatggacaacgtgaaccccttcaaccaccaccgcaacgcgggcctgcgctaccgctccatgctcctgggcaacgggcgctacgtgcccttccacatccaggtgccccagaagttcttcgccatcaagagcctcctgctcctgcccgggtcctacacctacgagtggaacttccgcaaggacgtcaacatgatcctgcagagctccctcggcaacgacctgcgcacggacggggcctccatccagttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggctaacgccaccaacgtgcccatctccatcccctcgcgcaactgggccgccttccgcggctggtccttcacgcgcctcaagacccgcgagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgaggggtacaacgtggcccagtgcaacatgaccaaggactggttcctggtccagatgctggcccactacaacatcggctaccagggcttccacgtgcccgagggctacaaggaccgcatgtactccttcttccgcaacttccagcccatgagccgccaggtggtcgacgaggtcaactacaaggactaccaggccgtcaccctggcctaccagcacaacaactcgggcttcgtcggctacctcgcgcccaccatgcgccagggccagccctaccccgccaactacccctacccgctcattggcaagagcgccgtcaccagcgtcacccagaaaaagttcctctgcgaccgcgtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtcagagtgcaccagccccaccgcggcgtcatcgaggccgtctacctgcgcacccccttctcggccggtaacgccaccacctaagctcttgcttcttgcaagcagctatggcctgcgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggagcccaccctgcgccgcaaccaagaggcgctctaccgcttcctcaactcccactccgcctactttcgctcccaccgcgcgcgcatcgagaaggccaccgccttcgaccgcatgaatcaagacatgtaaaccgtgtgtgtatttttatctgtgtctttaataaacagcgcttttatgtgacatgcatctctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgtttcacgctcgccagcaccgtcgcgtcggtgatactctccacgtcaaggtcctcggcgttggccatcccgaagggggtcatcttgcaggtctgccggcccatggtgggcacgcacccgggcttgtggttgcaatcgcagtgcagggggatcagcatcatctgggcctggtcggcgttcatccccgggtacatggccttcatgaacgcctccagctgtctgaaggcctgctgggccttggctccttcggtgaaaaagaccccgcaggacttgctagagaactggttggtagcgcagccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgaccatgtgctccttctggatcatggtgctgccgtgcaggcaccgcagcttgccctcggcctcggtgcacccatgcagccacagcgcgcacccggtgcactcccagttcttgtgggcgatctgggaatgcgagtgcacgaagccctgcaggaagcggcccatcatggtcgtcagggtcttgttgctggtgaaggtcagcgggatgccgcggtgctcctcgttgatgtacaggtggcagatgcggcggtacacctcgccctgctcgggcatcagctggaagttggatttcagctcgctttccacgcggtagcggtccatcagcagagccatgatttccatgcccttctcccaggccgagacgatgggcaggctcatggggttcttcaccatcatcttggagctagccgccgcagccagggggtcgctctcgtccagggtctcaaagctccgcttgccgtccttctcggtgatccgcacgggggggtagctgaagcccacggccgccagctcctcctcggcctgtctttcgtcctcgctgtcctggctgacgtcctgcaggaccacatgcttggtcttgcggggcttcttcttgggcggcagcggcggcggctgttcctgaggcgagggggagcgcgagtgctcgctcaccaccacaatttcttcttcttggtccgaggccacgcggcggtaggtatgtctcttcaggggcagaggcggaggcgacgggctctcctcgcggcccggcgggtggctggcagagccccttccgcgttcgggggtgcgctcccggcggcgctctgactgacttcctccgcggccggccattgtgttctcctagggaacaacaacaagcatggagactcagccatcgtcgccaacctcgccatctgcccccaccaccgccgacgagaagcagcagcagcagaatgaaagcttaaccgccccgccgcccagccccgcctccgacgcggccgcggtcccagacatgcaagagatggaggaatccatcgagattgacctgggctatgtgacgcccgcggagcacgaggaggagctggcagtgcgcttttcatcgagccaggaagaaaaagaacagcagccagaacaggaagcagagagcgagcagagtcaggctgggctcgagcatggcgactacctccacctgagcgggggggaggacgcgctcatcaagcatctggcccggcaggccctcatcgtcaaggacgcgctgctcgaccgcatcgaggtgcccctcagcgtggaggagctcagccgcgcctacgagctgaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgccctcttcaacctgggccccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcccgcttggcggtgctcaagcgcacggtcgagctgacccatttcgcctacccggccctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctacccctcagagtttggaagagcggcgcaagctcatgatggccgtggtcctggtgaccgtggagctggagtgcttgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcaacgagcgaaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcttgcaacccccagctgctgagcgagacccagatcatcggcaccttcgagttgcaagggcccagcgatgagggttcagccaaggggagtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaacttcccccgcaacatcttgcattactaccgtcacctccacagcccctactacttccaagaagaggcaacagcagcagaaaaagaccagaaaaccagcagcagctagaaaatccacagcggcaggtggactgaggatcgcagcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagccgcagaaaaaggcgggaattacgtcacctgtgcccttcgccctagccgcctccacccatcatcatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaaatcgccggatcggggagatcttccttcacgcctcgtcaggcggtcctgaccttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcagtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagccagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccggtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttcagacccttcctccccggcacctatcagtgcatctcgggaccctgccatcacaccttccacctgatcccgaataccaccacctcttccccagcgccgctccccactaacaaccaaactaaccaccaccaacgccaccgtcgagacctcgttgaatctaataccacccacaccggaggtgagctccgaggtcctgaatcctctgggatttattacggcccctgggaggtggtggggttaatagctttaggcttagtagcgggtgggcttttggctctctgctacctatacctcccttgcttttcctacttagtggtgctttgttgctggtttaagaaatggggaagatcaccctagtgtgcggtgtgctggtgacggtggtgctttcgattctgggagggggaagcgcggctgtagtgacggagaagaaggccgatccctgcttgactttcaaccccgataactgccggctgagttttcagccagatggcaatcggtgtgcggtgttgatcaagtgcggatgggaatgcgagagcgtggtgatccagtataaaaacaaaacctggaacaatactctcgcgtccacatggcagcccggggaccccgagtggtacaccgtctctgtccctggtgctgacggctccctccgcacggtgaacaacactttcatttttgagcacatgtgcgaaaccgccatgttcatgagcaagcagtacggtatgtggcccccacggaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacacacttttttcacacactttttcagaccatggcctctgttacttttttgataattgccagtctcattgctgttataagtaatgagaaactcactgtttacattggtactaatcacacactagaaggaattccaaaatcctcatggtattgctattttgatcaaaatccagagctaactgtagaattatgtggtaacagtggaaaaaataaaagcattcatttaattaactttgggtgcggaaaagatttgatactaattaatatcactagagagtatgcaggtatgtactactacgccacagaaggcatttcaaacatgcaattttatgaagttactgtgtctgaacctaccacgcctaaaatgaccacaaccacaaagactacagttgtcagcactatacatctcagtaccaatggcatttttgctatgcttcagatggccaataacagcaccagcatgccacacacacctacactacctagtgaggaaatacctaaatccatggtcgccatcatagctgctgtagtggtgtgtatgctgattattgttttgtgcatggcctactacgcttgctactacagaaggcacagactaagcgacaagctggaccaattactgagtgttgaattttaattttttagaaccatgaagatcctagccctttttgttttatctataattacatctgctctatgcaattctgacaatgaggatgttactgtcattgtcggatccaattacacactaaaaggcccaaccgagggtatgctttcgtggtattgctattttggaactgatactaagcaaacagagctctgtaatgctatgaaaggtcagatgcctacttccagaattaaacataaatgtaatggtactgacctaatactactcaatatcacaaaagcatatgctggcagttattcctgccctgcggccaacactgaggatatgattttttacaaagtaactgttgttgatcccaccactccaccaccacccaccacaactactaaagctaccacacacacacagcaaaccacaccagataaggggtttgccttaaaagttcagcaagaaggcggggcttcttttggagctaagacccctactcctgatcctcactgtccagggccattagtcagcagcattgtcggtgtgctttgtggtttagcaattgtgatcatctgcttgttcatttttgcttgctgctacagaaggcttcaccgacaaaaatcagacccactgctgaacctctatgtttaattttaatttcagaaccatgaaggcacttatcactttagtttttctttctttaattggcactgtttttagtgttagttttttgaaaaaaatcaatgtcactgagggagataatgtgacattggttggtgtagaaggtgctgaaaataccacctggacaaaatatcacatggatgggtggaaagaaatttgcacctggaatgtcactacttatacatgtgagggagttaaccttaccattgtcaatgttagcgaaattcaaaagggttggattaaagggcagagtgttagtgtcaccagtgagggatattttacccaacatacttttatctatgacattattgtcataccactgcccacacctagcccacctagcactactcagaccacacaaacaacctacactacacagagctccacaactaccttgcaaaccactcagacaaccacttacactacatccactcagcccaccaccactacagcagaggcgagtagctcaccaaccatcaaagtggcatttttgttactgccaccatctagcagtcctgctagtaccaatgagcagactactgaatttttgtccactattcagagcagcaccacagctacctcgagtgccttctctagcaccgccaatctcacctcgctttcctctacgccaatcagtaatgctactacctccccagctcctcttcccactcctctgaagcaatcagagtctagcacgcagctgcagatcaccctgctcattgtgatcggggtggtcatcctggcagtgctgctctactttatcttctgccgccgcatccccaacgcgaagccggcctacaagcccattgttatcggcacgccggagccgcttcaggtggagggaggtctaaggaatcttctcttctcttttacagtatggtgatttgaactatgattcctagacatttcattatcacttctctaatctgtgtgctccaagtctgtgccaccctcgctctcgtggctaacgcgagtccagactgcattggagcgttcgcctcctacgtgctctttgccttcatcacctgcatctgctgctgtagcatagtctgcctgcttatcaccttcttccagttcgttgactgggtctttgtgcgcatcgcctacctgcgccaccatccccagtaccgcgaccagagagtggcgcaactgttgagactcatctgataagcatgcgggctctgctacttctcgcgcttgtgctagctcccctcgccgcccccttaaccctcaaatcccccacccagtcccctgaagaggttcgaaaatgtaaattccaagaaccctggaaattcctttcatgctacaaactcaaatcagaaatgcaccccagctggatcatgatcattggaatcgtgaacatccttgcctgtaccctcatctcctttgtgatttacccctgctttaactttgggtggaacgcacccgaggcgctctggctcccgcctgatcccgacacaccaccacagcagcagcaaaatcaggcacatgcaccaccacagcctaggccacaatacatgcccatcttagactatgaggccgagccacagcgagccatgcttcctgctattagttacttcaatctaaccggcggagatgactgaccccatggccaacaacaccgtcaacgacctcctggacatggacggccgcgcctcggagcagcgactcgcccaactccgcatccgccagcagcaggagagagccgtcaaggagctgcaggatgcggtggccatccaccagtgcaagaaaggcatcttctgcctggtgaagcaggccaagatcaccttcgaggtgacttccaccgaccatcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccttgatcaagaccctctgcggcctccgcgacctcctccccatgaactaatca

SEQ ID NO: 21 - protein, 497 aa, Unknown
  Synthetic Construct
MESRNPFQQGLPAGFLSSSFVENMEVPAPECNLRLLAGTAARHSEDPESPGESQGTPTSPAAAAGGSRREPESRPGPSGGGGGVADLFPELRRVLTRSSSGRERGIKRERHDETNHRNELTVSLMSRKRPETVWWHEVQSTGTDEVSVMHERFSLEQVKTCWLEPEDDWEVAIRNYAKLALRPDKKYKITKLINIRNACYISGNGAEVEICLQERVAFRCCMMNMYPGVVGMDGVTFMNMRFRGDGYNGTVFMANTKLTVHGCSFFGFNNTCIEAWGQVGVRGCSFSANWMGIVGRTKSVLSVKKCLFERCHLGVMSEGEARIRHCASTETGCFVLCKGNAKIKHNMICGASDERGYQMLTCAGGNSHMLATVHVASHSRKPWPEFEHNVMTRCNMHLGSRRGMFMPYQCNLNYVKVLLEPDAMSRVSLTGVFDMNVEVWKILRYDESKTRCRACECGGKHARFQPVCVDVTEDLRPDHLVLSCTGTEFGSSGEESD

SEQ ID NO: 22 - protein, 187 aa, Unknown
  Synthetic Construct
MPRGNKKLKVELPPVEDLEEDWENSSQAEEEEMEEDWDSTQAEEDSLQDSLEEDEEEAEEEVEEAAAARPSSSAEKASSTDTISAPGRGPARPHSRWDETGRFPNPTTQTGKKERQGYKSWRGHKNAIVSCLQACGGNISFTRRYLLFHRGVNFPRNILHYYRHLHSPYYFQEEATAAEKDQKTSSS

SEQ ID NO: 23 - protein, 176 aa, Unknown
  Synthetic Construct
MGKITLVCGVLVTVVLSILGGGSAAVVTEKKADPCLTFNPDNCRLSFQPDGNRCAVLIKCGWECESVVIQYKNKTWNNTLASTWQPGDPEWYTVSVPGADGSLRTVNNTFIFEHMCETAMFMSKQYGMWPPRKENIVVFSIAYSACTVLITAIVCLSIHMLIAIRPRNNAEKEKQP

SEQ ID NO: 24 - protein, 306 aa, Unknown
  Synthetic Construct
MFNFNFRTMKALITLVFLSLIGTVFSVSFLKKINVTEGDNVTLVGVEGAENTTWTKYHMDGWKEICTWNVTTYTCEGVNLTIVNVSEIQKGWIKGQSVSVTSEGYFTQHTFIYDIIVIPLPTPSPPSTTQTTQTTYTTQSSTTTLQTTQTTTYTTSTQPTTTTAEASSSPTIKVAFLLLPPSSSPASTNEQTTEFLSTIQSSTTATSSAFSSTANLTSLSSTPISNATTSPAPLPTPLKQSESSTQLQITLLIVIGVVILAVLLYFIFCRRIPNAKPAYKPIVIGTPEPLQVEGGLRNLLFSFTVW

SEQ ID NO: 25 - protein, 134 aa, Unknown
  Synthetic Construct
MTDPMANNTVNDLLDMDGRASEQRLAQLRIRQQQERAVKELQDAVAIHQCKKGIFCLVKQAKITFEVTSTDHRLSYELLQQRQKFTCLVGVNPIVITQQSGDTKGCIHCSCDSPECVHTLIKTLCGLRDLLPMN

SEQ ID NO: 26 - DNA, 870 bp, Unknown
  Simian adenovirus A1321
  CDS (6)..(570): E1a
  CDS (664)..(869): E1a
gaaagatgaggcacctgagaaacctgcccgaggagaaaatcctcatcgcttccgggaacgagattctggaactggtggtaaatgccatgatgggcgacgaccctccggagccccccaccccatttgaggcaccttcgctacacgatttgtatgatctggaggtggatgtgcccgaggacgaccccaacgaggaggcggtaaatgatttatttagcgatgccgcgctgctagctgccgaggaggcttcgagctctagctcagacagcgactcctcactgcatacccctagacccggcagaggtgagaaaaagatccccgagcttaaaggggaagagatggacttgcgctgctatgaggaatgcttgcccccgagcgatgatgaggacgagcaggcgatccagaacgcagcgagtcagggaatgcaagccgccagagagagctttgcgctggactgcccgcctctgcccggacacggctgtaagtcttgtgaatttcatcgcatgaatactggagataaagctgtgttgtgtgcactttgctatatgagagcttacaaccattgtgtttacagtaagtgtgattaagttgaactttagagggaggcagagagcagggtgactgggcgatgactggtttatttatgtatatatgttctttatataggtcccgtctctgacgcagatgatgagacccccactacagagtccacttcgtcacccccagaaattggcacatctccacctgagaatattgttagaccagttcctgttagagccactgggaggagagcagctgtggaaagtttggatgacttgctacagggtggggatgaacctttggacttgtgtacccggaaacgccccaggcact

SEQ ID NO: 27 - protein, 257 aa, Unknown
  Synthetic Construct
MRHLRNLPEEKILIASGNEILELVVNAMMGDDPPEPPTPFEAPSLHDLYDLEVDVPEDDPNEEAVNDLFSDAALLAAEEASSSSSDSDSSLHTPRPGRGEKKIPELKGEEMDLRCYEECLPPSDDEDEQAIQNAASQGMQAARESFALDCPPLPGHGCKSCEFHRMNTGDKAVLCALCYMRAYNHCVYSPVSDADDETPTTESTSSPPEIGTSPPENIVRPVPVRATGRRAAVESLDDLLQGGDEPLDLCTRKRPRH

SEQ ID NO: 28 - DNA, 36542 bp, Unknown
  Simian adenovirus A1325
  repeat_region (1)..(129): ITR
  CDS (1604)..(2173): E1b\19K
  CDS (3452)..(3922): pIX
  misc_feature (3988)..(5609): IVa2    complement (3988..5318,5597..5609)
  misc_feature (5091)..(13826): pol    complement (5091..8651,13818..13826)
  misc_feature (8453)..(13826): pTP    complement (8453..10378,13818..13826)
  CDS (10809)..(11984): 52K
  CDS (12011)..(13789): pIIIa
  CDS (13866)..(15491): penton
  CDS (15498)..(16079): pVII
  CDS (16127)..(17167): V
  CDS (17193)..(17423): pX
  CDS (17495)..(18220): pVI
  CDS (18260)..(21136): hexon
  CDS (21161)..(21781): protease
  misc_feature (21867)..(23399): DBP    complement (21867..23399)
  CDS (23425)..(25812): 100K
  CDS (26430)..(27110): pVIII
  CDS (27114)..(27431): E3\12.5K
  CDS (27999)..(28526): E3\gp19K
  CDS (28559)..(29176): E3\CR1-beta
  CDS (29192)..(29800): E3\CR1-gamma
  CDS (29818)..(30681): E3\CR1-delta
  CDS (30692)..(30964): E3\RID-alpha
  CDS (30973)..(31404): E3\RID-beta
  CDS (32101)..(33429): fiber
  misc_feature (33543)..(34696): E4\orf6/7    complement (33543..33794,34526..34696)
  misc_feature (33794)..(34696): E4\orf6    complement (33794..34696)
  misc_feature (34605)..(34967): E4\orf4    complement (34605..34967)
  misc_feature (34980)..(35330): E4\orf3    complement (34980..35330)
  misc_feature (35330)..(35716): E4\orf2    complement (35330..35716)
  misc_feature (35760)..(36131): E4\orf1    complement (35760..36131)
  misc_feature (36413)..(36542): ITR
catcatcaataatatacctcaaactttttgtgcgcgttaatatgcaaatgaggcgtttgaatttggggatgcggggctgtgattggccgagaggagggcgaccgttaggggcggggcgagtgacgttttgatgacgcgaccgtgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaattccgcgtttatggcagggaggagtatttgccgagggccgagtagactttgaccgattacgtgggggtttcgattaccgtatttttcacctaaatttccgcgtacggtgtcaaagtccggtgtttttacgtaggtgtcagctgatcgccagggtatttaaacctgcgctctctagtcaagaggccactcttgagtgccagcgagtagagttttctcctccgcgccgcgagtcagatctacactttgaaagatgaggcacctgagaaacctgcccgaggagaaaatcctcatcgcttccgggaacgagattctggaactggtggtaaatgccatgatgggcgacgaccctccggagccccccaccccatttgaggcgccttcgctgtacgatttgtatgatctggaggtggatgtgcccgagaacgaccccaacgaggaggcggtgaatgatttgtttagcgatgccgcgctgctggctgccgagcaggctaatacggactctggctcagacagcgattcctctctccataccccgagacccggcagaggtgagaaaaagatccccgagcttaaaggggaagagctcgacctgcgctgctatgaggaatgcttgcctccgagcgatgatgaggaggacgaggaggcgattcgagctgcagcgagcgagggagtgaaagctgcgggcgagagctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagctgggaaggcagagggtgactgggtgctgactggtttatttatgtatatgtttttttttatgtgtaggtcccgtctctgacgtagatgagacccccacttcagagtgtatttcatcacccccagaaattggcgaggaaccgcccgaagatatcattcatagaccagttgcagtgagagtcaccgggcggagagcagctgtggagagtttgaatgacttgctacagggtggggatgaacctttggacttgtgtacccggaaacgccccaggcactaagtgccacacatgtgtgtttacttaaggtgatgtcagtatttatagggtgtggagtgcaataaaatccgtgttgactttaagtgcgtggtttatgactcagggtggggactgtgggtatataagcaggtgcagacctgtgtggtcagttcagagcaggactcatggagatctggacagtcttggaagactttcaccagactagacagctgctagagaactcatcggaggaagtctcttacctgtggagattctgcttcggtgggcctctagctaagctagtctatagggccaaacaggattatagggaacaatttgaggatattttgagagagtgtcctggtatttttgactctctcaacttgggccatcagtctcactttaaccagagtattctgagagcccttgacttttctactcctggcagaactaccgctgcggtagccttttttgcctttatccttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagtcaccccaggaacaccaacgccgccagcagccgcagcagcagcaagaggaggaggaggaccgagaagagaacccgagagccggtctggaccctccggtggcggaggaggaggagtagctgacttgtttcccgagctgtgccgggtgctgactaggtcttccagtggacgggagagggggattaagcgggagaggcatgaggagactagtcacagaactgaactgactgtcagtttgatgagccgcaggcgcccagaatcggtgtggtggcatgaggttcagtcgcagggggtagatgaggtctcggtgatgcatgagaaatattccctagaacaagtcaagacttgttggttggagcccgaggatgattgggaggtagccatcaggaattatgccaagctggctctgaggccagacaagaagtacaagattaccaaactgattaatatcagaaattcctgctacatttcggggaatggggccgaggtggagatcagtacccaggagagggtggccttcagatgttgtatgatgaatatgtacccgggggtggtgggcatggagggagtcacctttatgaacgcgaggttcaggggtgatgggtataatggggtggtctttatggccaacaccaagctgacagtgcacggttgctccttctttggctttaataacatgtgcatcgaggcctggggcagtgtttcagtgaggggatgcagtttttcagccaactggatgggggtcgtgggcagaaccaagagcaaggtgtcagtgaagaaatgcctgttcgagaggtgccacctgggggtgatgagcgagggcgaagccaaagtcaaacactgcgcctctaccgagacgggctgctttgtgctgatcaagggcaatgccaaagtcaagcataatatgatctgtggggcctcggatgagcgcggctaccagatgctgacctgcgccggtgggaacagccatatgctggccaccgtgcatgtggcctcgcacccccgcaagacatggcccgagttcgagcacaacgtcatgacccgctgcaatgtgcacctgggctcccgccgaggcatgttcatgccataccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggtgggtgggagcctgcatgatgggcagaatgactaaaatctgtgtttttctgcgcagcagcatgagcggaagcgcctcctttgagggaggggtattcagcccttatctgacggggcgtctcccctcctgggctggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggtgccggctactacagctctctggtggccaactcgagttccgccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacaaaggtgccctcgatcccgggggcgtagttgccctcgcagatctgcatctcccaggccttgagctcggagggggggatcatgtccacctgcggggcgatgaaaaaaacggtttccggggcgggggagatgagctgcgccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagtccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggttcggtccttccagggccgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcggggcggtcggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagagcagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagatcgtccagcgccgcttgccagtcgcgcacggccagcgcgcgctcgtaggggctgaggggcgtgccccagggcatggggtgcgtgagcgcggaggcatacatgccgcagatgtcgtagacgtagaggggctcctctaggacgccgatgtaggtggggtagcagcgccccccgcggatgctggcgcgcacgtagtcgtacagctcgtgcgagggcgcgaggaggcccgtgccgaggttggagcgctgcggcttttcggcgcggtagacgatctggcggaagatggcgtgggagttggaggagatggtgggcctctggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcatacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaggcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgctgacccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctcgtgctgtactacgtcctggccatcggcgtggccatcgtctgcctcgatggtggtcatgctgacgagcccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgtttcttcttgggcgctgcttccatgtcggtcagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcggcggttgacgtcctggatctgacgcctctgggtgaaggccacgggacccgtgagtttgaacctgaaagagagttcgacagaatcaatttcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttaagcgtggtggcgatgtgctcggtgacgaagaagtacatgatccagcggcggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcactcgaaggcccccgggagttcctccacttcctcttcttccatctcctccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctgtatctgggtgagggtggtctggaagtcgtcaaagtcgacgaagcggtggtaggctccggtgttgatggtgtaggagcagttggccatgacggaccagttgacggtctggtgaccgggacgcacgagctcgtggtacttgaggcgcgagtaggcgcgcgtgtcgaagatgtagtcgttgcaggtgcgcaccaggtactgatagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggcctgaaaactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccctagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggccagacttctcagtatgaccacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcgccgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcaacatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccattaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccttatgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgttcagaccaacctggaccgcatggtgaccgacgtgcgcgaggccgtggcccagcgcgagcggttccaccgcgagtccaacctgggatccatggtggcgctgaatgccttcctcagcacccagcccgccaacgtgccccggggccaggaggactacaccaacttcatcagtgccctgcgcctgatggtgaccgaggtgccccagagcgaggtgtaccagtccgggccggactacttcttccagaccagtcgccagggcttgcagaccgtgaacctgagccaggctttcaagaacttgcagggattgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccaccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaagccgccagtcctttcccgagcttgcccttctcgctaaacagcattcgcagcagcgagctgggcaggatcacgcgcccgcgcttgctgggcgaggaggagtacttgaatgactcgctgttgagacccgagcgggagaagaacttccccaataacggaatagagagcctggtggacaagatgagccgctggaaaacgtatgcgcaggagcacagggacgatccccgggcgtcgcagggggccacgagccggggcagcgcggcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgtttagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaacggggtcaaagtagatgatgactatgatggtagtcaggatatcttggagtatgagtgggtggagtttgagctgcccgaaggcaacttctcggtgaccatgaccatcgacctgatgaacaacgccattatcgacaattacttggcggtggggcggcagaacggggtgctggagagcgacatcggcgtgaagttcgacacgcgcaacttcaggctcggttgggaccccgtgaccgagctggtcatgccgggcgtgtacaccaacgaggccttccaccccgacatcgtcctgctgcccggctgcggcgtggacttcaccgagagccgcctcagcaacctgctgggcatccgcaagcggcagcccttccaggagggtttccagatcatgtacgaggacctggaggggggcaacatccccgcgctgctggacgtcgaagcctacgagaaaagcaaggaggaggccgccgcagcggcgaccgcggccgtggctactgctgcgaccaccgatgcagatgcagctactactaccaggggcgatacattcgccacccaggcggaggaagcagccgccctagcggcgaccgatgatagtgaaagtaagatagtcatcaagccggtggagaaggacagcaaggacaggagctacaacgttctatcggatggaaagaacaccgcctaccgcagctggtacctggcctacaactacggcgaccctgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggcggcggtgaaggaggaaagaaagccccgcaaactgaagcgggtcaaaaaggacaaaaaggaggaggaagatgacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggccgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagactgagcccgtgaagcccagcaccagcaccatggaggtgcagacggatccctggatgccggcgccggcttccaccaccaccacccgccgaagacgcaagtacggcgcggccagcctgctgatgcccaactacgcgctgcatccttccatcatccccacgccgggctaccgcggcacgcgcttctaccgcggctacaccagcagccgccgccgcaagaccaccacccgccgccgccgtcgtcgcagccgccgcagcagcaccgcgacttccgccttggtgcggagagtgtaccgcagcgggcgcgagcctctgaccctgccgcgcgcgcgctaccacccgagcatcgccatttaactaccgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgctgggtccgtggacatgccccaggtggaggaggagctgcctcccctggacaagcgcggcgacaagcgaccgcgtcccgacgctgaggagacgctgctgacgcacacggacgagccgcccccgtacgaggaggcggtgaaactgggtctgcccaccacgcggcccgtggcgcctctggccaccggggtgctgaaacccagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatgtatgtccgccgaccagaaggaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggtgacaaccgcgtgctggacatggccagcacctactttgacatccgcggcgtgctggatcggggccccagcttcaaaccctactccggcaccgcctacaacgctctggctcccaaagctgctcctaatcctagtcagtggtatgaaaccaccgagggaacaaatggaaacgctgacgccactactactaaacatagttttggtttggctgccatgaagggcgataatattgcagctgaaggactgcaaataggaacagattctacctctggatctgatacacccatctatgcagataaactgtatcagccagagcctcagataggagaggaatcatggacagacaacgatggaaccaatgaaaaattcggtggaagagttcttaaacctgacaccaacatgaaaccctgctatggctcatttgccaaacccactaataacaaaggtggtcaagcaaaacaaaaggcaacggaaggaacagctgtggattatgatgttgacatgaactttttcgatggtagagatgcagctgctaactttactccagaagtagtgttgtatgctgaaaatgtggatttggaaactccagacacccatattgtatacaaaccaggaacttcagatttgagttcccatgtgaatttgggtcaacagtccatgcccaacagacccaactacattggattcagagataactttatcgggcttatgtactacaacagcactggcaatatgggtgtactggctggtcaggcctcccagctgaatgctgtggtggacttgcaggacagaaacaccgaactgtcctaccagctcttgcttgactctctgggtgacagaaccaggtatttcagtatgtggaatcaggcggtggacagttatgaccccgatgtgcgcattattgaaaaccatggtatagaagatgaacttcccaactactgtttcccaattgatgctgtgggcatcaccagaacctatcaaggcataaaagtacaaaatggaactggcactggaacgacatgggaaaaagatactgatgttagtacagccaacgaaataggaattggcaacaatctggccatggagatcaacatccaggccaacctgtggcggaacttcctctacgcgaacgtggcgctgtacctgcccgactcctacaagtacacgccggccaacatcacgctgcccaccaacaccaacacctacgattacatgaacggccgcgtggtggcgccctcgctggtggacgcctacatcaacatcggggcgcgctggtcgctggaccccatggacaacgtcaatcccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggatggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgaccgggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagccgctcttgcttcttgcaagatgacggcctgtggctccggcgagcaggagctcagggccatcctccgcgacctgggctgcgggccctgcttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcagacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaagcgctctaccgcttcctcaacgcccactccgcctactttcgctcccaccgcgcgcgcatcgagaaggccaccgccttcgaccgcatgaatcaagacatgtaaaccgtgtgtatgtgaatgctttattcatcataataaacagcacatgtttatgccaccttctctgaggctctgactttatttagaaatcgaaggggttctgccggctctcggcgtgccccgcgggcagggatacgttgcggaactggtacttggacagccacttgaactcggggatcagcagcttgggcacggggaggtcggggaacgagtcgctccacagcttgcgcgtgagttgcagggcgcccagcaggtcgggcgcggagatcttgaaatcgcagttgggacccgcgttctgcgcgcgagagttacggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccacaggacttgctagagaactggttggtggcgcagcccgcgtcgtgcacgcagcagcgcgcgtcgttgttggccagctgcaccacgctgcgcccccagcggttctgggtgatcttggcccggtcggggttctccttcagcgcgcgctgcccattctcgctcgccacatccatctcgatcgtgtgctccttctggatcatcacggtcccgtgcaggcaccgcagcttgccctcggcctcggtgcacccgtgcagccacagcgcgcagccggtgctctcccagttcttgtgggcgatctgggagtgcgagtgcacgaagccctgcaggaagcggcccatcatcgtggtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgtcatcttagtcgccgccgccgaggtcagggggtcgttctcgtccagggtctcaaacactcgcttgccgtccttctcggtgatgcgcacgggggggaaggcgaagcccacggccgccagctcctcctcggcctgcctttcgtcctcgctgtcctggctgatgtcttgcaaaggcacatgcttggtcttgcggggtttctttttgggtggcagaggcggcggcggagacgtgctgggcgagcgcgagttttcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattatgttctcctagggagcaacaagcatggagactcagccatcgtcgccaacatcgccatctgcccccgccgacgagaaccagcagcagaatgaaagcttaaccgccccgccgcccagccccacctccgacgccgcagccccagacatgcaagagatggagaaatccatcgagattgacctgggctacgtgacgcccgcggagcacgaggaggagctggcagcgcgcttttcagccccggaagagaaccaccaagagcagccagagcaggaagcagagagcgagcagcagcaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgccctgctcaacctgggtcccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctgaaggccctgtggaccgggttcgacgagcgcaccaccgccgcggacctggccgacctcattttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacttgctgcgcctggccaactacctggcctaccactcggacgtgatcgaggacgtcagcggcgagggtctgctcgagtgccactgtcgctgcaacctctgcacgccgcaccgctccctggcctgcaacccccagctgctgagcgagacccagatcatcggcaccttcgagttgcaaggccccggcgaggagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccgccggaggatttggaggaagactgggagagcagtcaggcagaggagatggaagactgggacagcactcaggcagaggaggacagcctgcaagacagtctggaggaggaagacgaggtggaggaggaggcagaggaagaagcagccgccgccagaccgtcgtcctcggcggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagaaaaccagcggcagctagaaaatccacagcggcggcaggtggactgaggatcgcggcgaacgagccggcgcagacccgggagctgaggaatcggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatcctcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcggctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggcctcgactcccacctgcttcggatcttcagccagcgaccgatcctggtcgagcgcgagcaaggacagacccgtctgaccctgtactgcatctgcaaccaccccggcctgcatgaaagtctttgttgtctgctgtgtactgagtataataaaagctgagatcagcgactactccggactcgattgtggtgttcctgctatcaaccggtccctgttcttcaccgggaacgagaccgagctccagctccagtgtaagccccacaagaagtatctcacctggctgttccagggctccccgatcgccgttgtcaaccactgcgacaacgacggagtcctgctgagcggccccgccaaccttactttttccacccgcagaagcaagctccagctcttccaacccttcctccccgggacctatcagtgcctctcgggaccctgccatcacaccttccacctgatcccgaataccacagcggcgctccccgctactaacaaccaaactacccaccaacgccaccgtcgcgacctttcctctgaatctaatactaccacccacaccggaggtgagctccgaggtcaaccaacctctgggatttactacggcccctgggaggtggtggggttaatagcgctaggcctagttgcgggtgggcttttggctctctgctacctatacctcccttgctgttcttacttagtggtgctgtgttgctggtttaagaaatggggaagatcaccctagtgagctgcggtgcgctggtggcggtggtgctttcgattgtgggactgggcggcgcggctgtagtgaaggagaaggccgatccctgcttgcatttcaatcccgacaaatgccagctgagttttcagcccgatggcaatcggtgcgcggtgctgatcaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaacaatactttcatttttgcacacatgtgcgacacggtcatgtggatgagcaagcagtacgatatgtggccccccacgaaggagaacatcgtggtcttctccatcgcttacagcctgtgcacggcgctaatcaccgctatcgtgtgcctgagcattcacatgctcatcgctattcgccccagaaataatgccgaaaaagagaaacagccataacacgttttttcacacacctttttcagaccatggcctctgttaaattttttgctttatttgccagtctcattaccgtcattcatggaatgagtaatgagaaaattactatttacactggcactaatcacacattgaaaggtccagaaaaatccacagaagtttcatggtattgttattttaatgaatcagatgtagctactgaactctgtggaaacaacaacaaaaaaaatgagagcattactctcatcaagtttcaatgtggatctgacttaaccctcattaacatcactagagactatgtaggtatgtattatggaactacagcaggcatttcggacatggaattttatcaagtttctgtgtctgaacccaccacgcctagaatgaccacaaccacaaaaactacacctactaccaccacacagctcactaccaatggcttttttgccatgcttcaagtggctgaaaatagcaccagcattcaacccaccccacccagtgaggaaattcccaaatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctatgccttttagttttttatatcattacctctgctctttgtgaatcagtggataaagatgttactattaccactggttctaattatacactgaaaggaccaccctcaggtatgctttcgtggtattgctattttggaactgacactgatcaaactgaattatgcaattttcaaaaaggcaaaacctcaaactctaaaatctctaattatcaatgcaatggcactgatctgatactactcaatgtcacgaaagcatatggtggcagttattcatgccctggacaaaacactgaagaaatgattttttacaaagtggaagtggttgatcccactactccacctccacccgccacaactactcacaccacacacacagaacaaagcacagcagaggcagcaaagttagccttgcaggtccaagacagttcatttgttggcattacccctacacctgatcagcggtgtccggggctgctcgtcagcggcattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcgctctagttttttgttctttgattggcattgtttttaatagtaaaattaccagagttagctttattaaacatgttaatgtaactgaaggagataacatcacactagcaggtgtagaaggtgctcaaaacaccacctggacaaaataccatctaggatggagagatatttgcacctggaatgtaacttattattgcataggagttaatcttaccattgttaacgctaaccaatctcagaatgggttaattaaaggacagagtgttagtgtgaccagtgatgggtactatacccagcatagttttaactacaacattactgtcataccactgcctacgcctagcccacctagcactaccgcacagacaaccacatacagtacatcaaatcagcctaccaccactacagcagcagaggttgccagctcgtctggggtccgagtggcatttttgatgttggccccatctagcagtcccactgctagtaccaatgagcagactactgaatttttgtccactgtcgagagccacaccacagctacctccagtgccttctctagcaccgccaatctctcctcgctttcctctacaccaatcagtcccgctactactcctagccccgctcctcttcccactcccctgaagcaaacagacggcggcatgcaatggcagatcaccctgctcattgtgatcgggttggtcatcctggccgtgttgctatactacatcttctgccgccgcattcccaacgcgcaccgcaagccggcctacaagcccatcgttatcgggcagccggagccgcttcaggtggaagggggtctaaggaatcttctcttctcttttacagtatggtgattgaattatgattcctagacaattcttgatcactattcttatctgcctcctccaagtctgtgccaccctcgctctggtggccaacgccagtccagactgtattgggcccttcgcctcctacgtgctctttgccttcatcacctgcatctgctgctgtagcatagtctgcctgcttatcaccttcttccagttcattgactggatctttgtgcgcatcgcctacctgcgccaccacccccagtaccgcgaccagcgagtggcgcggctgctcaggctcctctgataagcatgcgggctctgctacttctcgcgcttctgctgttagtgctcccccgtcccgtcgacccccggacccccacccagtcccccgaggaggtccgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcaacctcaggcacacgcactaccaccaccaccacagcctaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgattaaataaaaaaaataatcatttgatttgaaataaagatacaatcatattgatgatttgagtttaataaaaataaagaatcacttacttgaaatctgataccaggtctctgtccatgttttctgccaacaccacttcactcccctcttcccagctctggtactgcaggccccggcgggctgcaaacttcctccacaccctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgactcctcgggaaaactcatctccaacacggccaccaaggccgccgcccctctcagtttttccaacaacaccatttcccttaacatggatacccctctttataccaaagatggaaaattatccttacaagtttctccaccattaaacatattaaaatcaaccattctgaacactttagctgtagcttatggatcaggtttaggactcagtggtggcactgctcttgcagtacagttggcctctccactcacctttgatgaaaaaggaaatattaaaattaacctagccagtggtccattaacagttgatgcaagtcgacttagtatcaactgcaaaagaggggttactgtcactaccgcaggagatgcaattgaaagcaacataagctggcctaaaggtataagatttgaaggtgatgccatagctgcaaacattggcagaggattggaatttggaaccactagtacagagactgatgtcacagatgcatacccaattcaagttaaattgggtactggtctcacctttgacagtacaggcgccattgttgcatggaacaaagaggatgataaacttacattatggaccacagccgacccctcgccaaattgcaaaatatactctgaaaaagatgctaaactcacactttgcttgacaaaatgtggaagccaaattctgggcactgtgactgtattggcagtgaataatggaagtctcaacccaattacaaacacagtaagcactgcacttgtctccctcaagtttgatgcaagtggagttttgctaagcagctccacattagacaaagaatattggaacttccgaaagggagatgttacacctgctgaaccctatactaatgctataggttttatgcctaacataaaggcctatcctaaaaacacatctgcagcttcaaaaagccatattgtcagtcaagtttatctcaatggggatgaaaccaaacctctgatgctgattattacttttaatgaaactgaggatgcaacttgcacctacagtatcacttttcaatggaaatgggatagtactaagtacacaggtaaaacacttgctaccagctccttcaccttctcctacattgcccaagaatgaatactgtattccaccctgcatgccaacccttcccaccccactctgtctatggaaaaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggcgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgtcgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgccccctccagaacacgctgcccatgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccgacaatggcaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtcccggcgcttggaacgctcggtgttgaagttgtaaaacagccactctctcagaccgtgcagcagatctagggcctcaggagtgatgaagatcccatcatgcctgatggctctaatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctaagctcctccctcagcaataactgtaagtactctttcatatcctctccgaaatttttagccataggaccgccaggaatgagattaggacaagccacattacagataaaccgaagtcccccccagtgagcattgccaaatgtaagattgaaataagcatgctggctagacccggtgatatcttccagataactggacagaaaatcgcccaggcaatttttaagaaaatcaacaaaagaaaaatcttccaggtgcacgtttagggcctcgggaacaacgatggagtaagtgcaaggggtgcgttccagcatggttagttagctgatctgtaaaaaaacaaaaaataaaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcggccgaggaagcaataaggcactacaatgctcagtctcaagtccagcaaagcgatgccatgcggatgaagcacaaaattctcaggtgcgtacaaaatgtaattactcccctcctgcacaggcagcaaagccccagatccctccagatacacatacaaagcctcagcgtccatagcttaccgagcagcagcacacaacaggcgcaagagtcagagaaaggctgagctctaacctgtcccccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaactgccgtcatttccgggttcccacgctacgtcatcagaattcgactttcaaatccgtcgaccgttaaacacgtcactcgccccgcccctaacggtcgccctcctctcggccaatcacagccccgcatccccaaattcaaacgcctcatttgcatattaacgcgcacaaaaagtttgaggtatattatttgatgatg

SEQ ID NO: 29 - protein, 190 aa, Unknown
  Synthetic Construct
MEIWTVLEDFHQTRQLLENSSEEVSYLWRFCFGGPLAKLVYRAKQDYREQFEDILRECPGIFDSLNLGHQSHFNQSILRALDFSTPGRTTAAVAFFAFILDKWSQETHFSRDYRLDCLAVALWRTWRCQRLNAISGYLPVQPVDTLRILSLQSPQEHQRRQQPQQQQEEEEDREENPRAGLDPPVAEEEE

SEQ ID NO: 30 - protein, 157 aa, Unknown
  Synthetic Construct
MMGRMTKICVFLRSSMSGSASFEGGVFSPYLTGRLPSWAGVRQNVMGSTVDGRPVQPANSSTLTYATLSSSSVDAAAAAAAASAASAVRGMALGAGYYSSLVANSSSANNPASLNEEKLLLLMAQLEALTQRLGELTQQVAQLQAETRAAVATVKTK

SEQ ID NO: 31 - protein, 392 aa, Unknown
  Synthetic Construct
MHPVLRQMRPHHPPPQQQPPPQPALLPPPQQQLPATTAAAAVSGAGQTSQYDHLALEEGEGLARLGASSPERHPRVQMKRDAREAYVPKQNLFRDRSGEEPEEMRAARFHAGRELRRGLDRKRVLRDEDFEADELTGISPARAHVAAANLVTAYEQTVKEESNFQKSFNNHVRTLIAREEVTLGLMHLWDLLEAIVQNPTSKPLTAQLFLVVQHSRDNEAFREALLNITEPEGRWLLDLVNILQSIVVQERGLPLSEKLAAINFSVLSLGKYYARKIYKTPYVPIDKEVKIDGFYMRMTLKVLTLSDDLGVYRNDRMHRAVSASRRRELSDQELMHSLQRALTGAGTEGESYFDMGADLHWQPSRRALEAAAGPYVEEVDDEVDEEGEYLED

SEQ ID NO: 32 - protein, 593 aa, Unknown
  Synthetic Construct
MQQQQPPPDPAMRAALQSQPSGINSSDDWTQAMQRIMALTTRNPEAFRQQPQANRLSAILEAVVPSRSNPTHEKVLAIVNALVENKAIRGDEAGLVYNALLERVARYNSTNVQTNLDRMVTDVREAVAQRERFHRESNLGSMVALNAFLSTQPANVPRGQEDYTNFISALRLMVTEVPQSEVYQSGPDYFFQTSRQGLQTVNLSQAFKNLQGLWGVQAPVGDRATVSSLLTPNSRLLLLLVAPFTDSGSINRNSYLGYLINLYREAIGQAHVDEQTYQEITHVSRALGQDDPGNLEATLNFLLTNRSQKIPPQYALSAEEERILRYVQQSVGLFLMQEGATPSAALDMTARNMEPSMYASNRPFINKLMDYLHRAAAMNSDYFTNAILNPHWLPPPGFYTGEYDMPDPNDGFLWDDVDSSVFSPRPGANERPLWKKEGSDRRPSSALSGREGAAAAVPEAASPFPSLPFSLNSIRSSELGRITRPRLLGEEEYLNDSLLRPEREKNFPNNGIESLVDKMSRWKTYAQEHRDDPRASQGATSRGSAARKRRWHDRQRGLMWDDEDSADDSSVLDLGGSGGNPFAHLRPRIGRMM

SEQ ID NO: 33 - protein, 542 aa, Unknown
  Synthetic Construct
MMRRAYPEGPPPSYESVMQQAMAAAMQPPLEAPYVPPRYLAPTEGRNSIRYSELAPLYDTTRLYLVDNKSADIASLNYQNDHSNFLTTVVQNNDFTPTEASTQTINFDERSRWGGQLKTIMHTNMPNVNEFMYSNKFKARVMVSRKTPNGVKVDDDYDGSQDILEYEWVEFELPEGNFSVTMTIDLMNNAIIDNYLAVGRQNGVLESDIGVKFDTRNFRLGWDPVTELVMPGVYTNEAFHPDIVLLPGCGVDFTESRLSNLLGIRKRQPFQEGFQIMYEDLEGGNIPALLDVEAYEKSKEEAAAAATAAVATAATTDADAATTTRGDTFATQAEEAAALAATDDSESKIVIKPVEKDSKDRSYNVLSDGKNTAYRSWYLAYNYGDPEKGVRSWTLLTTSDVTCGVEQVYWSLPDMMQDPVTFRSTRQVSNYPVVGAELLPVYSKSFFNEQAVYSQQLRAFTSLTHVFNRFPENQILVRPPAPTITTVSENVPALTDHGTLPLRSSIRGVQRVTVTDARRRTCPYVYKALGIVAPRVLSSRTF

SEQ ID NO: 34 - protein, 194 aa, Unknown
  Synthetic Construct
MSILISPSNNTGWGLRAPSKMYGGARQRSTQHPVRVRGHFRAPWGALKGRVRSRTTVDDVIDQVVADARNYTPAAAPVSTVDAVIDSVVADARRYARAKSRRRRIARRHRSTPAMRAARALLRRARRTGRRAMLRAARRAASGSSSAGRTRRRAATAAAAAIASMSRPRRGNVYWVRDAATGVRVPVRTRPPRT

SEQ ID NO: 35 - protein, 347 aa, Unknown
  Synthetic Construct
MSKRKYKEEMLQVIAPEIYGPAAAVKEERKPRKLKRVKKDKKEEEDDGLVEFVREFAPRRRVQWRGRKVKPVLRPGTTVVFTPGERSGSASKRSYDEVYGDEDILEQAAERLGEFAYGKRSRPAPLKEEAVSIPLDHGNPTPSLKPVTLQQVLPSAAPRRGFKREGGEDLYPTMQLMVPKRQKLEDVLEHMKVDPEVQPEVKVRPIKQVAPGLGVQTVDIKIPTEPMETQTEPVKPSTSTMEVQTDPWMPAPASTTTTRRRRKYGAASLLMPNYALHPSIIPTPGYRGTRFYRGYTSSRRRKTTTRRRRRRSRRSSTATSALVRRVYRSGREPLTLPRARYHPSIAI

SEQ ID NO: 36 - protein, 77 aa, Unknown
  Synthetic Construct
MALTCRLRVPITGYRGRKPRRRRLTGNGLRRHHHRRRRAISKRLGGGFLPALIPIIAAAIGAIPGIASVAVQASQRH

SEQ ID NO: 37 - protein, 242 aa, Unknown
  Synthetic Construct
MEDINFSSLAPRHGTRPFMGTWSDIGNSQLNGGAFNWSSLWSGLKNFGSTLKTYGNKAWNSSTGQALREKLKEQNFQQKVVDGLASGINGVVDLANQAVQKQINSRLDAVPPAGSVDMPQVEEELPPLDKRGDKRPRPDAEETLLTHTDEPPPYEEAVKLGLPTTRPVAPLATGVLKPSSSSQPATLDLPPPASRPSTVAKPLPPVAVASRAPRGRPQANWQSTLNSIVGLGVQSVKRRRCY

SEQ ID NO: 38 - protein, 959 aa, Unknown
  Synthetic Construct
MYVRRPEGGGRGASPSCKMATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNALAPKAAPNPSQWYETTEGTNGNADATTTKHSFGLAAMKGDNIAAEGLQIGTDSTSGSDTPIYADKLYQPEPQIGEESWTDNDGTNEKFGGRVLKPDTNMKPCYGSFAKPTNNKGGQAKQKATEGTAVDYDVDMNFFDGRDAAANFTPEVVLYAENVDLETPDTHIVYKPGTSDLSSHVNLGQQSMPNRPNYIGFRDNFIGLMYYNSTGNMGVLAGQASQLNAVVDLQDRNTELSYQLLLDSLGDRTRYFSMWNQAVDSYDPDVRIIENHGIEDELPNYCFPIDAVGITRTYQGIKVQNGTGTGTTWEKDTDVSTANEIGIGNNLAMEINIQANLWRNFLYANVALYLPDSYKYTPANITLPTNTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 39 - protein, 207 aa, Unknown
  Synthetic Construct
MTACGSGEQELRAILRDLGCGPCFLGTFDKRFPGFMAPHKLACAIVNTAGRETGGEHWLAFAWNPRSHTCYLFDPFGFSDERLKQIYQFEYEGLLRRSALATEDRCVTLEKSTQTVQGPRSAACGLFCCMFLHAFVHWPDRPMDKNPTMNLLTGVPNGMLQSPQVEPTLRRNQEALYRFLNAHSAYFRSHRARIEKATAFDRMNQDM

SEQ ID NO: 40 - protein, 796 aa, Unknown
  Synthetic Construct
METQPSSPTSPSAPADENQQQNESLTAPPPSPTSDAAAPDMQEMEKSIEIDLGYVTPAEHEEELAARFSAPEENHQEQPEQEAESEQQQAGLEHGDYLSGAEDVLIKHLARQCIIVKDALLDRAEVPLSVAELSRAYERNLFSPRVPPKRQPNGTCEPNPRLNFYPVFAVPEALATYHIFFKNQKIPVSCRANRTRADALLNLGPGARLPDIASLEEVPKIFEGLGSDETRAANALQGSGEEHEHHSALVELEGDNARLAVLKRTVELTHFAYPALNLPPKVMSAVMDQVLIKRASPLSEEEMQDPESSDEGKPVVSDEQLARWLGASSTPQSLEERRKLMMAVVLVTVELECLRRFFADAETLRKVEENLHYLFRHGFVRQACKISNVELTNLVSYMGILHENRLGQNVLHTTLRGEARRDYIRDCVYLYLCHTWQTGMGVWQQCLEEQNLKELCKLLQKNLKALWTGFDERTTAADLADLIFPERLRLTLRNGLPDFMSQSMLQNFRSFILERSGILPATCSALPSDFVPLTFRECPPPLWSHCYLLRLANYLAYHSDVIEDVSGEGLLECHCRCNLCTPHRSLACNPQLLSETQIIGTFELQGPGEEGKGGLKLTPGLWTSAYLRKFVPEDYHPFEIRFYEDQSQPPKAELSACVITQGAILAQLQAIQKSRQEFLLKKGHGVYLDPQTGEELNPSFPQDAPRKQQEAESGAAAAAGGFGGRLGEQSGRGDGRLGQHSGRGGQPARQSGGGRRGGGGGRGRSSRRQTVVLGGESKQHGYHLRSGSGSRRPGPQ

SEQ ID NO: 41 - protein, 227 aa, Unknown
  Synthetic Construct
MSKEIPTPYMWSYQPQMGLAAGAAQDYSTRMNWLSAGPAMISRVNDILAHRNQILLEQSAITATPRHHLNPRNWPAALVYQEIPQPTTVLLPRDAQAEVQLTNSGVQLAGGAALCRHRPAQGIKRLVIRGRGTQLNDEVVSSSLGLRPDGVFQLAGSGRSSFTPRQAVLTLESSSSQPRSGGIGTLQFVEEFTPSVYFNPFSGSPGHYPDEFIPNFDAISESVDGYD

SEQ ID NO: 42 - protein, 106 aa, Unknown
  Synthetic Construct
MSHGGAADLARLRHLDHCRRFRCFARDLAEFAYFELPEEHPQGPAHGVRIVVEGGLDSHLLRIFSQRPILVEREQGQTRLTLYCICNHPGLHESLCCLLCTEYNKS

SEQ ID NO: 43 - protein, 176 aa, Unknown
  Synthetic Construct
MGKITLVSCGALVAVVLSIVGLGGAAVVKEKADPCLHFNPDKCQLSFQPDGNRCAVLIKCGWECENVRIEYNNKTRNNTLASVWQPGDPEWYTVSVPGADGSPRTVNNTFIFAHMCDTVMWMSKQYDMWPPTKENIVVFSIAYSLCTALITAIVCLSIHMLIAIRPRNNAEKEKQP

SEQ ID NO: 44 - protein, 206 aa, Unknown
  Synthetic Construct
MASVKFFALFASLITVIHGMSNEKITIYTGTNHTLKGPEKSTEVSWYCYFNESDVATELCGNNNKKNESITLIKFQCGSDLTLINITRDYVGMYYGTTAGISDMEFYQVSVSEPTTPRMTTTTKTTPTTTTQLTTNGFFAMLQVAENSTSIQPTPPSEEIPKSMIGIIVAVVVCMLIIALCMVYYAFCYRKHRLNDKLEHLLSVEF

SEQ ID NO: 45 - protein, 203 aa, Unknown
  Synthetic Construct
MKILCLLVFYIITSALCESVDKDVTITTGSNYTLKGPPSGMLSWYCYFGTDTDQTELCNFQKGKTSNSKISNYQCNGTDLILLNVTKAYGGSYSCPGQNTEEMIFYKVEVVDPTTPPPPATTTHTTHTEQSTAEAAKLALQVQDSSFVGITPTPDQRCPGLLVSGIVGVLSGLAVIIICMFIFACCYRRLYRQKSDPLLNLYV

SEQ ID NO: 46 - protein, 288 aa, Unknown
  Synthetic Construct
MKAVSALVFCSLIGIVFNSKITRVSFIKHVNVTEGDNITLAGVEGAQNTTWTKYHLGWRDICTWNVTYYCIGVNLTIVNANQSQNGLIKGQSVSVTSDGYYTQHSFNYNITVIPLPTPSPPSTTAQTTTYSTSNQPTTTTAAEVASSSGVRVAFLMLAPSSSPTASTNEQTTEFLSTVESHTTATSSAFSSTANLSSLSSTPISPATTPSPAPLPTPLKQTDGGMQWQITLLIVIGLVILAVLLYYIFCRRIPNAHRKPAYKPIVIGQPEPLQVEGGLRNLLFSFTVW

SEQ ID NO: 47 - protein, 91 aa, Unknown
  Synthetic Construct
MIPRQFLITILICLLQVCATLALVANASPDCIGPFASYVLFAFITCICCCSIVCLLITFFQFIDWIFVRIAYLRHHPQYRDQRVARLLRLL

SEQ ID NO: 48 - protein, 144 aa, Unknown
  Synthetic Construct
MRALLLLALLLLVLPRPVDPRTPTQSPEEVRKCKFQEPWKFLKCYRQKSDMHPSWIMIIGIVNILACTLISFVIYPCFDFGWNSPEALYLPPEPDTPPQQPQAHALPPPPQPRPQYMPILDYEAEPQRPMLPAISYFNLTGGDD

SEQ ID NO: 49 - protein, 443 aa, Unknown
  Synthetic Construct
MSKKRVRVDDDFDPVYPYDADNAPTVPFINPPFVSSDGFQEKPLGVLSLRLADPVTTKNGEITLKLGEGVDLDSSGKLISNTATKAAAPLSFSNNTISLNMDTPLYTKDGKLSLQVSPPLNILKSTILNTLAVAYGSGLGLSGGTALAVQLASPLTFDEKGNIKINLASGPLTVDASRLSINCKRGVTVTTAGDAIESNISWPKGIRFEGDAIAANIGRGLEFGTTSTETDVTDAYPIQVKLGTGLTFDSTGAIVAWNKEDDKLTLWTTADPSPNCKIYSEKDAKLTLCLTKCGSQILGTVTVLAVNNGSLNPITNTVSTALVSLKFDASGVLLSSSTLDKEYWNFRKGDVTPAEPYTNAIGFMPNIKAYPKNTSAASKSHIVSQVYLNGDETKPLMLIITFNETEDATCTYSITFQWKWDSTKYTGKTLATSSFTFSYIAQE

SEQ ID NO: 50 - DNA, 29910 bp, Unknown
  Simian adenovirus A1325
  CDS (9)..(1514): E1b\55K
  CDS (23632)..(24192): 22K
  CDS (25488)..(26114): E3\CR1-alpha
  CDS (29500)..(29904): E3\14.7K
cttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagtcaccccaggaacaccaacgccgccagcagccgcagcagcagcaagaggaggaggaggaccgagaagagaacccgagagccggtctggaccctccggtggcggaggaggaggagtagctgacttgtttcccgagctgtgccgggtgctgactaggtcttccagtggacgggagagggggattaagcgggagaggcatgaggagactagtcacagaactgaactgactgtcagtttgatgagccgcaggcgcccagaatcggtgtggtggcatgaggttcagtcgcagggggtagatgaggtctcggtgatgcatgagaaatattccctagaacaagtcaagacttgttggttggagcccgaggatgattgggaggtagccatcaggaattatgccaagctggctctgaggccagacaagaagtacaagattaccaaactgattaatatcagaaattcctgctacatttcggggaatggggccgaggtggagatcagtacccaggagagggtggccttcagatgttgtatgatgaatatgtacccgggggtggtgggcatggagggagtcacctttatgaacgcgaggttcaggggtgatgggtataatggggtggtctttatggccaacaccaagctgacagtgcacggttgctccttctttggctttaataacatgtgcatcgaggcctggggcagtgtttcagtgaggggatgcagtttttcagccaactggatgggggtcgtgggcagaaccaagagcaaggtgtcagtgaagaaatgcctgttcgagaggtgccacctgggggtgatgagcgagggcgaagccaaagtcaaacactgcgcctctaccgagacgggctgctttgtgctgatcaagggcaatgccaaagtcaagcataatatgatctgtggggcctcggatgagcgcggctaccagatgctgacctgcgccggtgggaacagccatatgctggccaccgtgcatgtggcctcgcacccccgcaagacatggcccgagttcgagcacaacgtcatgacccgctgcaatgtgcacctgggctcccgccgaggcatgttcatgccataccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggtgggtgggagcctgcatgatgggcagaatgactaaaatctgtgtttttctgcgcagcagcatgagcggaagcgcctcctttgagggaggggtattcagcccttatctgacggggcgtctcccctcctgggctggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggtgccggctactacagctctctggtggccaactcgagttccgccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacaaaggtgccctcgatcccgggggcgtagttgccctcgcagatctgcatctcccaggccttgagctcggagggggggatcatgtccacctgcggggcgatgaaaaaaacggtttccggggcgggggagatgagctgcgccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagtccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggttcggtccttccagggccgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcggggcggtcggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagagcagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagatcgtccagcgccgcttgccagtcgcgcacggccagcgcgcgctcgtaggggctgaggggcgtgccccagggcatggggtgcgtgagcgcggaggcatacatgccgcagatgtcgtagacgtagaggggctcctctaggacgccgatgtaggtggggtagcagcgccccccgcggatgctggcgcgcacgtagtcgtacagctcgtgcgagggcgcgaggaggcccgtgccgaggttggagcgctgcggcttttcggcgcggtagacgatctggcggaagatggcgtgggagttggaggagatggtgggcctctggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcatacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaggcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgctgacccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctcgtgctgtactacgtcctggccatcggcgtggccatcgtctgcctcgatggtggtcatgctgacgagcccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgtttcttcttgggcgctgcttccatgtcggtcagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcggcggttgacgtcctggatctgacgcctctgggtgaaggccacgggacccgtgagtttgaacctgaaagagagttcgacagaatcaatttcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttaagcgtggtggcgatgtgctcggtgacgaagaagtacatgatccagcggcggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcactcgaaggcccccgggagttcctccacttcctcttcttccatctcctccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctgtatctgggtgagggtggtctggaagtcgtcaaagtcgacgaagcggtggtaggctccggtgttgatggtgtaggagcagttggccatgacggaccagttgacggtctggtgaccgggacgcacgagctcgtggtacttgaggcgcgagtaggcgcgcgtgtcgaagatgtagtcgttgcaggtgcgcaccaggtactgatagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggcctgaaaactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccctagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggccagacttctcagtatgaccacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcgccgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcaacatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccattaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccttatgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgttcagaccaacctggaccgcatggtgaccgacgtgcgcgaggccgtggcccagcgcgagcggttccaccgcgagtccaacctgggatccatggtggcgctgaatgccttcctcagcacccagcccgccaacgtgccccggggccaggaggactacaccaacttcatcagtgccctgcgcctgatggtgaccgaggtgccccagagcgaggtgtaccagtccgggccggactacttcttccagaccagtcgccagggcttgcagaccgtgaacctgagccaggctttcaagaacttgcagggattgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccaccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaagccgccagtcctttcccgagcttgcccttctcgctaaacagcattcgcagcagcgagctgggcaggatcacgcgcccgcgcttgctgggcgaggaggagtacttgaatgactcgctgttgagacccgagcgggagaagaacttccccaataacggaatagagagcctggtggacaagatgagccgctggaaaacgtatgcgcaggagcacagggacgatccccgggcgtcgcagggggccacgagccggggcagcgcggcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgtttagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaacggggtcaaagtagatgatgactatgatggtagtcaggatatcttggagtatgagtgggtggagtttgagctgcccgaaggcaacttctcggtgaccatgaccatcgacctgatgaacaacgccattatcgacaattacttggcggtggggcggcagaacggggtgctggagagcgacatcggcgtgaagttcgacacgcgcaacttcaggctcggttgggaccccgtgaccgagctggtcatgccgggcgtgtacaccaacgaggccttccaccccgacatcgtcctgctgcccggctgcggcgtggacttcaccgagagccgcctcagcaacctgctgggcatccgcaagcggcagcccttccaggagggtttccagatcatgtacgaggacctggaggggggcaacatccccgcgctgctggacgtcgaagcctacgagaaaagcaaggaggaggccgccgcagcggcgaccgcggccgtggctactgctgcgaccaccgatgcagatgcagctactactaccaggggcgatacattcgccacccaggcggaggaagcagccgccctagcggcgaccgatgatagtgaaagtaagatagtcatcaagccggtggagaaggacagcaaggacaggagctacaacgttctatcggatggaaagaacaccgcctaccgcagctggtacctggcctacaactacggcgaccctgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggcggcggtgaaggaggaaagaaagccccgcaaactgaagcgggtcaaaaaggacaaaaaggaggaggaagatgacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggccgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagactgagcccgtgaagcccagcaccagcaccatggaggtgcagacggatccctggatgccggcgccggcttccaccaccaccacccgccgaagacgcaagtacggcgcggccagcctgctgatgcccaactacgcgctgcatccttccatcatccccacgccgggctaccgcggcacgcgcttctaccgcggctacaccagcagccgccgccgcaagaccaccacccgccgccgccgtcgtcgcagccgccgcagcagcaccgcgacttccgccttggtgcggagagtgtaccgcagcgggcgcgagcctctgaccctgccgcgcgcgcgctaccacccgagcatcgccatttaactaccgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgctgggtccgtggacatgccccaggtggaggaggagctgcctcccctggacaagcgcggcgacaagcgaccgcgtcccgacgctgaggagacgctgctgacgcacacggacgagccgcccccgtacgaggaggcggtgaaactgggtctgcccaccacgcggcccgtggcgcctctggccaccggggtgctgaaacccagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatgtatgtccgccgaccagaaggaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggtgacaaccgcgtgctggacatggccagcacctactttgacatccgcggcgtgctggatcggggccccagcttcaaaccctactccggcaccgcctacaacgctctggctcccaaagctgctcctaatcctagtcagtggtatgaaaccaccgagggaacaaatggaaacgctgacgccactactactaaacatagttttggtttggctgccatgaagggcgataatattgcagctgaaggactgcaaataggaacagattctacctctggatctgatacacccatctatgcagataaactgtatcagccagagcctcagataggagaggaatcatggacagacaacgatggaaccaatgaaaaattcggtggaagagttcttaaacctgacaccaacatgaaaccctgctatggctcatttgccaaacccactaataacaaaggtggtcaagcaaaacaaaaggcaacggaaggaacagctgtggattatgatgttgacatgaactttttcgatggtagagatgcagctgctaactttactccagaagtagtgttgtatgctgaaaatgtggatttggaaactccagacacccatattgtatacaaaccaggaacttcagatttgagttcccatgtgaatttgggtcaacagtccatgcccaacagacccaactacattggattcagagataactttatcgggcttatgtactacaacagcactggcaatatgggtgtactggctggtcaggcctcccagctgaatgctgtggtggacttgcaggacagaaacaccgaactgtcctaccagctcttgcttgactctctgggtgacagaaccaggtatttcagtatgtggaatcaggcggtggacagttatgaccccgatgtgcgcattattgaaaaccatggtatagaagatgaacttcccaactactgtttcccaattgatgctgtgggcatcaccagaacctatcaaggcataaaagtacaaaatggaactggcactggaacgacatgggaaaaagatactgatgttagtacagccaacgaaataggaattggcaacaatctggccatggagatcaacatccaggccaacctgtggcggaacttcctctacgcgaacgtggcgctgtacctgcccgactcctacaagtacacgccggccaacatcacgctgcccaccaacaccaacacctacgattacatgaacggccgcgtggtggcgccctcgctggtggacgcctacatcaacatcggggcgcgctggtcgctggaccccatggacaacgtcaatcccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggatggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgaccgggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagccgctcttgcttcttgcaagatgacggcctgtggctccggcgagcaggagctcagggccatcctccgcgacctgggctgcgggccctgcttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcagacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaagcgctctaccgcttcctcaacgcccactccgcctactttcgctcccaccgcgcgcgcatcgagaaggccaccgccttcgaccgcatgaatcaagacatgtaaaccgtgtgtatgtgaatgctttattcatcataataaacagcacatgtttatgccaccttctctgaggctctgactttatttagaaatcgaaggggttctgccggctctcggcgtgccccgcgggcagggatacgttgcggaactggtacttggacagccacttgaactcggggatcagcagcttgggcacggggaggtcggggaacgagtcgctccacagcttgcgcgtgagttgcagggcgcccagcaggtcgggcgcggagatcttgaaatcgcagttgggacccgcgttctgcgcgcgagagttacggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccacaggacttgctagagaactggttggtggcgcagcccgcgtcgtgcacgcagcagcgcgcgtcgttgttggccagctgcaccacgctgcgcccccagcggttctgggtgatcttggcccggtcggggttctccttcagcgcgcgctgcccattctcgctcgccacatccatctcgatcgtgtgctccttctggatcatcacggtcccgtgcaggcaccgcagcttgccctcggcctcggtgcacccgtgcagccacagcgcgcagccggtgctctcccagttcttgtgggcgatctgggagtgcgagtgcacgaagccctgcaggaagcggcccatcatcgtggtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgtcatcttagtcgccgccgccgaggtcagggggtcgttctcgtccagggtctcaaacactcgcttgccgtccttctcggtgatgcgcacgggggggaaggcgaagcccacggccgccagctcctcctcggcctgcctttcgtcctcgctgtcctggctgatgtcttgcaaaggcacatgcttggtcttgcggggtttctttttgggtggcagaggcggcggcggagacgtgctgggcgagcgcgagttttcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattatgttctcctagggagcaacaagcatggagactcagccatcgtcgccaacatcgccatctgcccccgccgacgagaaccagcagcagaatgaaagcttaaccgccccgccgcccagccccacctccgacgccgcagccccagacatgcaagagatggagaaatccatcgagattgacctgggctacgtgacgcccgcggagcacgaggaggagctggcagcgcgcttttcagccccggaagagaaccaccaagagcagccagagcaggaagcagagagcgagcagcagcaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgccctgctcaacctgggtcccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctgaaggccctgtggaccgggttcgacgagcgcaccaccgccgcggacctggccgacctcattttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacttgctgcgcctggccaactacctggcctaccactcggacgtgatcgaggacgtcagcggcgagggtctgctcgagtgccactgtcgctgcaacctctgcacgccgcaccgctccctggcctgcaacccccagctgctgagcgagacccagatcatcggcaccttcgagttgcaaggccccggcgaggagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccgccggaggatttggaggaagactgggagagcagtcaggcagaggagatggaagactgggacagcactcaggcagaggaggacagcctgcaagacagtctggaggaggaagacgaggtggaggaggaggcagaggaagaagcagccgccgccagaccgtcgtcctcggcggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagaaaaccagcggcagctagaaaatccacagcggcggcaggtggactgaggatcgcggcgaacgagccggcgcagacccgggagctgaggaatcggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatcctcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcggctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggcctcgactcccacctgcttcggatcttcagccagcgaccgatcctggtcgagcgcgagcaaggacagacccgtctgaccctgtactgcatctgcaaccaccccggcctgcatgaaagtctttgttgtctgctgtgtactgagtataataaaagctgagatcagcgactactccggactcgattgtggtgttcctgctatcaaccggtccctgttcttcaccgggaacgagaccgagctccagctccagtgtaagccccacaagaagtatctcacctggctgttccagggctccccgatcgccgttgtcaaccactgcgacaacgacggagtcctgctgagcggccccgccaaccttactttttccacccgcagaagcaagctccagctcttccaacccttcctccccgggacctatcagtgcctctcgggaccctgccatcacaccttccacctgatcccgaataccacagcggcgctccccgctactaacaaccaaactacccaccaacgccaccgtcgcgacctttcctctgaatctaatactaccacccacaccggaggtgagctccgaggtcaaccaacctctgggatttactacggcccctgggaggtggtggggttaatagcgctaggcctagttgcgggtgggcttttggctctctgctacctatacctcccttgctgttcttacttagtggtgctgtgttgctggtttaagaaatggggaagatcaccctagtgagctgcggtgcgctggtggcggtggtgctttcgattgtgggactgggcggcgcggctgtagtgaaggagaaggccgatccctgcttgcatttcaatcccgacaaatgccagctgagttttcagcccgatggcaatcggtgcgcggtgctgatcaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaacaatactttcatttttgcacacatgtgcgacacggtcatgtggatgagcaagcagtacgatatgtggccccccacgaaggagaacatcgtggtcttctccatcgcttacagcctgtgcacggcgctaatcaccgctatcgtgtgcctgagcattcacatgctcatcgctattcgccccagaaataatgccgaaaaagagaaacagccataacacgttttttcacacacctttttcagaccatggcctctgttaaattttttgctttatttgccagtctcattaccgtcattcatggaatgagtaatgagaaaattactatttacactggcactaatcacacattgaaaggtccagaaaaatccacagaagtttcatggtattgttattttaatgaatcagatgtagctactgaactctgtggaaacaacaacaaaaaaaatgagagcattactctcatcaagtttcaatgtggatctgacttaaccctcattaacatcactagagactatgtaggtatgtattatggaactacagcaggcatttcggacatggaattttatcaagtttctgtgtctgaacccaccacgcctagaatgaccacaaccacaaaaactacacctactaccaccacacagctcactaccaatggcttttttgccatgcttcaagtggctgaaaatagcaccagcattcaacccaccccacccagtgaggaaattcccaaatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctatgccttttagttttttatatcattacctctgctctttgtgaatcagtggataaagatgttactattaccactggttctaattatacactgaaaggaccaccctcaggtatgctttcgtggtattgctattttggaactgacactgatcaaactgaattatgcaattttcaaaaaggcaaaacctcaaactctaaaatctctaattatcaatgcaatggcactgatctgatactactcaatgtcacgaaagcatatggtggcagttattcatgccctggacaaaacactgaagaaatgattttttacaaagtggaagtggttgatcccactactccacctccacccgccacaactactcacaccacacacacagaacaaagcacagcagaggcagcaaagttagccttgcaggtccaagacagttcatttgttggcattacccctacacctgatcagcggtgtccggggctgctcgtcagcggcattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcgctctagttttttgttctttgattggcattgtttttaatagtaaaattaccagagttagctttattaaacatgttaatgtaactgaaggagataacatcacactagcaggtgtagaaggtgctcaaaacaccacctggacaaaataccatctaggatggagagatatttgcacctggaatgtaacttattattgcataggagttaatcttaccattgttaacgctaaccaatctcagaatgggttaattaaaggacagagtgttagtgtgaccagtgatgggtactatacccagcatagttttaactacaacattactgtcataccactgcctacgcctagcccacctagcactaccgcacagacaaccacatacagtacatcaaatcagcctaccaccactacagcagcagaggttgccagctcgtctggggtccgagtggcatttttgatgttggccccatctagcagtcccactgctagtaccaatgagcagactactgaatttttgtccactgtcgagagccacaccacagctacctccagtgccttctctagcaccgccaatctctcctcgctttcctctacaccaatcagtcccgctactactcctagccccgctcctcttcccactcccctgaagcaaacagacggcggcatgcaatggcagatcaccctgctcattgtgatcgggttggtcatcctggccgtgttgctatactacatcttctgccgccgcattcccaacgcgcaccgcaagccggcctacaagcccatcgttatcgggcagccggagccgcttcaggtggaagggggtctaaggaatcttctcttctcttttacagtatggtgattgaattatgattcctagacaattcttgatcactattcttatctgcctcctccaagtctgtgccaccctcgctctggtggccaacgccagtccagactgtattgggcccttcgcctcctacgtgctctttgccttcatcacctgcatctgctgctgtagcatagtctgcctgcttatcaccttcttccagttcattgactggatctttgtgcgcatcgcctacctgcgccaccacccccagtaccgcgaccagcgagtggcgcggctgctcaggctcctctgataagcatgcgggctctgctacttctcgcgcttctgctgttagtgctcccccgtcccgtcgacccccggacccccacccagtcccccgaggaggtccgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcaacctcaggcacacgcactaccaccaccaccacagcctaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatca

SEQ ID NO: 51 - protein, 502 aa, Unknown
  Synthetic Construct
MESRNPFQQGLPSGLLSSSFVENMEVPAPECNLRLLASTAGRHAEDPESPVTPGTPTPPAAAAAARGGGGPRREPESRSGPSGGGGGGVADLFPELCRVLTRSSSGRERGIKRERHEETSHRTELTVSLMSRRRPESVWWHEVQSQGVDEVSVMHEKYSLEQVKTCWLEPEDDWEVAIRNYAKLALRPDKKYKITKLINIRNSCYISGNGAEVEISTQERVAFRCCMMNMYPGVVGMEGVTFMNARFRGDGYNGVVFMANTKLTVHGCSFFGFNNMCIEAWGSVSVRGCSFSANWMGVVGRTKSKVSVKKCLFERCHLGVMSEGEAKVKHCASTETGCFVLIKGNAKVKHNMICGASDERGYQMLTCAGGNSHMLATVHVASHPRKTWPEFEHNVMTRCNVHLGSRRGMFMPYQCNMQFVKVLLEPDAMSRVSLTGVFDMNVELWKILRYDESKTRCRACECGGKHARLQPVCVEVTEDLRPDHLVLSCNGTEFGSSGEESD

SEQ ID NO: 52 - protein, 187 aa, Unknown
  Synthetic Construct
MPRGSSKKLKVELPPPPEDLEEDWESSQAEEMEDWDSTQAEEDSLQDSLEEEDEVEEEAEEEAAAARPSSSAEKASSTDTISAPGRGRGGRAHSRWDETGRFPNPTTQTGKKERQGYKSWRGHKNAIVSCLQACGGNISFTRRYLLFHRGVNFPRNILHYYRHLHSPYYCFQEEAETQQQQQKTSGS

SEQ ID NO: 53 - protein, 209 aa, Unknown
  Synthetic Construct
MKVFVVCCVLSIIKAEISDYSGLDCGVPAINRSLFFTGNETELQLQCKPHKKYLTWLFQGSPIAVVNHCDNDGVLLSGPANLTFSTRRSKLQLFQPFLPGTYQCLSGPCHHTFHLIPNTTAALPATNNQTTHQRHRRDLSSESNTTTHTGGELRGQPTSGIYYGPWEVVGLIALGLVAGGLLALCYLYLPCCSYLVVLCCWFKKWGRSP

SEQ ID NO: 54 - protein, 135 aa, Unknown
  Synthetic Construct
MTDPLANNNVNDLLLDMDGRASEQRLAQLRIRQQQERAVKELQDGIAIHQCKKGIFCLVKQAKISYEVTQTDHRLSYELLQQRQKFTCLVGVNPIVITQQSGDTKGCIHCSCDSPDCVHTLIKTLCGLRDLLPMN

SEQ ID NO: 55 - DNA, 1440 bp, Unknown
  Simian adenovirus A1325
  CDS (882)..(1146): E1a
  CDS (1234)..(1439): E1a
catcatcaataatatacctcaaactttttgtgcgcgttaatatgcaaatgaggcgtttgaatttggggatgcggggctgtgattggccgagaggagggcgaccgttaggggcggggcgagtgacgttttgatgacgcgaccgtgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaattccgcgtttatggcagggaggagtatttgccgagggccgagtagactttgaccgattacgtgggggtttcgattaccgtatttttcacctaaatttccgcgtacggtgtcaaagtccggtgtttttacgtaggtgtcagctgatcgccagggtatttaaacctgcgctctctagtcaagaggccactcttgagtgccagcgagtagagttttctcctccgcgccgcgagtcagatctacactttgaaagatgaggcacctgagaaacctgcccgaggagaaaatcctcatcgcttccgggaacgagattctggaactggtggtaaatgccatgatgggcgacgaccctccggagccccccaccccatttgaggcgccttcgctgtacgatttgtatgatctggaggtggatgtgcccgagaacgaccccaacgaggaggcggtgaatgatttgtttagcgatgccgcgctgctggctgccgagcaggctaatacggactctggctcagacagcgattcctctctccataccccgagacccggcagaggtgagaaaaagatccccgagcttaaaggggaagagctcgacctgcgctgctatgaggaatgcttgcctccgagcgatgatgaggaggacgaggaggcgattcgagctgcagcgagcgagggagtgaaagctgcgggcgagagctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagctgggaaggcagagggtgactgggtgctgactggtttatttatgtatatgtttttttttatgtgtaggtcccgtctctgacgtagatgagacccccacttcagagtgtatttcatcacccccagaaattggcgaggaaccgcccgaagatatcattcatagaccagttgcagtgagagtcaccgggcggagagcagctgtggagagtttgaatgacttgctacagggtggggatgaacctttggacttgtgtacccggaaacgccccaggcact

SEQ ID NO: 56 - protein, 157 aa, Unknown
  Synthetic Construct
KIPELKGEELDLRCYEECLPPSDDEEDEEAIRAAASEGVKAAGESFSLDCPTLPGHGCKSCEFHRMNTGDKNVMCALCYMRAYNHCVYSPVSDVDETPTSECISSPPEIGEEPPEDIIHRPVAVRVTGRRAAVESLNDLLQGGDEPLDLCTRKRPRH

SEQ ID NO: 57 - DNA, 36643 bp, Unknown
  Simian adenovirus A1295
  repeat_region (1)..(127): ITR
  CDS (1602)..(2153): E1b\19K
  CDS (3481)..(3906): pIX
  misc_feature (3971)..(5592): IVa2    complement (3971..5301,5580..5592)
  misc_feature (5074)..(13817): pol    complement (5074..8646,13809..13817)
  misc_feature (8448)..(13817): pTP    complement (8448..10376,13809..13817)
  CDS (10806)..(11984): 52K
  CDS (12011)..(13780): pIIIa
  CDS (13857)..(15458): penton
  CDS (15466)..(16044): pVII
  CDS (16092)..(17117): V
  CDS (17141)..(17371): pX
  CDS (17407)..(18180): pVI
  CDS (18290)..(21109): hexon
  CDS (21130)..(21756): protease
  misc_feature (21838)..(23373): DBP  complement (21838..23373)
  CDS (23399)..(25819): 100K
  CDS (26453)..(27133): pVIII
  CDS (27137)..(27454): E3\12.5K
  CDS (28028)..(28555): E3\gp19K
  CDS (28589)..(29317): E3\CR1-beta
  CDS (29333)..(29953): E3\CR1-gamma
  CDS (29976)..(30848): E3\CR1-delta
  CDS (30860)..(31132): E3\RID-alpha
  CDS (31135)..(31572): E3\RID-beta
  CDS (32227)..(33552): fiber
  misc_feature (33646)..(34793): E4\orf6/7    complement (33646..33897,34620..34793)
  misc_feature (33897)..(34793): E4\orf6    complement (33897..34793)
  misc_feature (34699)..(35064): E4\orf4    complement (34699..35064)
  misc_feature (35076)..(35426): E4\orf3    complement (35076..35426)
  misc_feature (35426)..(35812): E4\orf2    complement (35426..35812)
  misc_feature (35865)..(36236): E4\orf1    complement (35865..36236)
  repeat_region (36517)..(36643): ITR   complement (36517..36643)
catcatcaaataatatacctcaaactttttgtgcgcgttaatatgcaaatgagccgtttgaatttggggatggaggaaggtgattggccgagaggagggcgaccgttaggggcggggcgagtgacgttttgatgacgtggtcgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagatgaggcacctgagagacctgcccgatgagaaaatcatcatcgcttccgggaacgagattctggaactggtggtaaatgccatgatgggcgacgaccctccggagccccccaccccatttgagacaccttcgctacacgatttgtatgatctggaggtggatgtgcccgaggacgaccccaacgaggaggcggtaaatgatttatttagcgatgccgcactgctagctgccgaggaggcttcgagccctagctcagacagcgactcttcactgcatacccctagacccggcagaggtgagaaaaagatccccgagcttaaaggggaagagatggacttgcgctgctatgaggaatgcttgcccccgagcgatgatgaggacgagcaggcgatccagaacgtagcgagccagggagtgcaagccgccagcgagagctttgcgctggactgcccgcctctgcccggacacggctgtaagtcttgtgaatttcatcgcttgaatactggagataaagctgtgttatgtgcactttgctatatgagagcttacaaccattgtgtttacagtaagtgtgattaagttgaactttagagggaggcagagagcggggtgactgggcgatgactggtttatttatgtatatatgttctttatataggtcccgtctctgacgcagatgatgagacccccactacagagtccatttcgtcacccccagaaattggcacatctccacctgagaatattgttagaccagttcctgttagagccactgggaggagagcagctgtggaatgtttggatgacttgctacagggtggggatgaacctttggacttgtgtacccggaaacgccccaggcactaagtgccacacatgtgtgtttacttgaggtgatgtcagtatttatagggtgtggagtgcaataaaaaatgtgttgactttaagtgcgtggtttatgactcaggggtggggactgtgggtatataagcaggtgcagacctgtgtggttagctcagagcggcatggagatttggacggtcttggaagactttcacaagactagacagctgctagagaacgcctcggacggagtctcttacctgtggagattctgcttcggcggcgacctagctaagctagtctacagggccaaacaggattatagggaacaatttgaggttattttgagagagtgttctggtctttttgacgctcttaacttgggccatcagtctcactttaaccagaggatttcgagagcccttgactttactactcctggcagaaccactgcggcagtagccttttttgcttttcttcttgacaaatggagtcaagaaacccatttcagcagggattaccagctggatttcttagcagtagctttgtggagaacatggaagtgccagcgcctgaatgcaatctcaggctacttgccggtacagccgctagacactctgaggatcctgaatctccaggagagtcccagggcacgccaacgtcgccagcagcagcagcaggaggatcaagaagagaacccgagagccggcctggaccctccggcggaggaggagtagctgacctgtttcctgaactgcgccgggtgctgactaggtcttcgagtggtcgggagagggggattaagcgggagaggcatgatgagactaatcacagaactgaactgactgtgggtctgatgagccgtaagaggccagaaacagtgtggtggcatgaggtgcagtcgactggcacagatgaggtgtcagtcatgcatgagaagttttccctagaacaagtcaagacttgttggttggagcctgaggatgattgggaggtagccatcaggaattatgccaagctggctctcaggccagacaagaagtacaagattactaagctgataaatatcagaaatgcctgctacatctcagggaatggggctgaagtggagatctgtcttcaggatagagtggctttcagatgctgtatgatgaatatgtacccgggagtggtgggcatggatggggtcacctttatgaacatgaggttcaggggagatgggtataatggcacggtctttatggccaatacgaagctgacagtccatggctgctccttctttgggtttaataacacctgcattgaggcctggggtcaggtcggtgtgaggggctgcagtttttcagccaactggatgggggtcgtgggcaggaccaaaagtgtgctgtccgtgaagaaatgcttgtttgagaggtgccacctgggggtgatgagcgagggcgaagccagaatccgccactgcgcctctaccgagacgggctgcttcgtgctgtgcaagggcaatgctaagatcaagcataatatgatttgtggagcctcggacgagcgcggctaccagatgctgacctgcgccagtgggaacagccatatgctggccaccgtgcatgtggcttcccattcccgcaagccctggcctgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcggggaggacctgcatgagggccagaatgactgaaatctgtgcttttctgtgtgttgcagcagcatgagcggaagcggctcctttgagggaggggtattcagcccttatctgacggggcgtctcccctcatgggcgggagtgcgtcagaatgtgatgggatccacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggattttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttagaagggaaggcgtgaaagaatttggcgacgcccttgtgcccgcccaggttttccatgcactcatccatgatgatggcgatgggcccgtgggcggcggcctgggcaaaaacgtttcgggggtcggacacatcatagttgtggtcctgggtgagatcatcataggccattttaatgaatttggggcggagggtgcctgactgggggacaaaggtaccctcgatcccgggggcgtagttcccctcgcagatctgcatctcccaggctttgagctcggagggggggatcatgtccacctgcggggcgataaagaacacggtttccggggcgggggagatgagctgcgccgaaagcaagttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcatccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcttcgagcggtgtgccacggtcctcctcgtagaggaaccccgcccactccgagacgaaagcccgggtccaggccagcacgaaggaggccacgtgggacgggtagcggtcgttgtccaccagcgggtccactttttccagggtatgcaaacacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagtttggtggcgaaggagccgtagagggcgttggaaaggagcttggcgatagagcgcatggtctggttcttttccttgtctgcgcgctccttggccgcgatgttgagctgcacgtactcgcgcgccacgcacttccattcggggaagacggtggtcagctcgtcgggcacgattctgacctgccagccccggttatgcagggtgataaggtccacactggtggccacctcgccgcgcaggggctcattagtccagcagaggcgcccgcccttgcgcgagcagaaggggggcagggggtcgagcatgacctcgtcgggggggtcggcatcgatggtgaagatgccgggcaggagatcggggtcaaagtagctgatggaagtggccagatcgtccagggcagcttgccattcgcgcacggccagcgcgcgctcgtaggggctgaggggcgtgccccagggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggcgcgaggagccccgggcccaggttggtgcgactgggcttttcggcgcggtagacgatctggcgaaagatggcatgcgagttggaggagatggtgggcctttggaagatgttgaagtgggcgtgggggagaccgaccgagtcgcggatgaagtgggcgtaggagtcttgcagcttggcgacgagctcggcggtgacgaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaggtgtccctgaccatgactttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaacggttggggcacctcggcccggttgttgatgacctgggcggcgagcacgatctcgtcgaaaccgttgatgttgtggcccacgatgtaaagttccacgaatcgcgggcggcccttgacgtggggcagtttcttgagctcctcgtaggtgagctcgtcggggtcgctgaggccgtgctgctcgagcgcccagtcggcgagatgggggttggcgcggaggaaggaagtccagagatccacggccagggcggtctgcaggcggtcccggtactgacgaaactgctgcccgacggccattttttcgggggtgacgcagtagaaggtgcgggggtccccgtgccaacgatcccatttgagctggagggcaagatcgagggcgagctcgacgaggcggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggtgtgaccaccgtcccccgtttcttcttgggcggctggggaggcggtgcctcttccatggttagaagcggcggcgaggacgcgcgccgggcggcaggggcggctctgggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtaaaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggttggagggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcctgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggccggatgaaactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgttttttgtttttgccagatgcatcccgtactgcggcagatgcgcccccaccaccctccaccgcaacaacagccccctcctccacagccggcgcttctgcccccgccccagcagcagcagcaacttccagccacgaccgccgcggccgccgtgagcggggctggacagagttatgaccaccagctggccttggaagagggcgaggggctggcgcgcctgggggcgtcgtcgccggagcggcacccgcgcgtgcagatgaaaagggacgctcgtgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcacagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcaggcggtcccccctacgtagaagaggtggacgaggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctacaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgatgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgctctgcgcctgatggtgaccgaggtgccccagagcgaggtgtaccagtccgggccggactacttcttccagaccagtcgccagggcttgcagaccgtgaacctgagccaggctttcaagaacttgcagggattgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacttgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataagctgatggactacttgcatcgggcggccgccatgaactcggactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgtcgcccgtcctcggcgctgtccggccgggagggtgctgccgcggcggtgcccgaggccgccagtcctttcccgagcttgcccttctcgctgaacagtattcgcagcagcgagctgggcaggatcacgcgtccgcgcttgctgggcgaggaggagtacttgaatgactcgctgttgagacccgagcgggagaaaaacttccccaacaacgggatagagagcctggtggacaagatgagccgctggaagacgtatgcgcaggagcacagggacgatccgtcgcagggggccacgagccggggcagcgcggcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgtttagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaacggggtcacagtaggggatgactatgatggtagtcaggatatcttggagtatgaatgggtggagtttgagctgcccgaaggcaacttctcggtgaccatgaccatcgacctgatgaacaacgccatcatcgacaattacttggcggtggggcggcagaacggggtgctcgagagcgacatcggcgtgaagttcgacaccaggaacttcaggctgggctgggaccccgtgaccgagctggtcatgccaggggtgtacaccaacgaggccttccatcccgatattgtcttgctgcccggctgcggggtggacttcaccgagagccgcctcagcaacctgctgggcattcgcaagaggcagcccttccaggagggtttccagatcatgtacgaggatctggaggggggcaacatccccgcgctcctggatgtcgacgcctatgagaaaagcaaggaggaagcagcagctgaagcaactgcagcggtagccaccgcctctaccgaggtcaggggcgataattttgcaagcgctgcggcagtggcagcggccgaggcggctgaaaccgaaagtaagatagtcattcagccggtggagaaggatagcaaggacaggagctacaacgtgctgccggacaagataaacaccgcctaccgcagctggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctttcgagccgcaccttctaaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccccgcggcggcggtgaaggaggaaagaaagccccgcaaaatcaagcgggtcaaaaaggacaaaaaggaagaagatgatgtggacggattggtggagtttgtgcgcgagttcgcccccaggcggcgcgtgcagtggcgcgggcggaaggtgcaaccggtgctgagacccggcaccaccgtggttttcacgccaggcgagcgctccggcaccgcctccaagcgctcctacgacgaggtgtacggggatgatgatattctggaacaggcggccgagcgcctgggcgagtttgcttacggcaagcgcagccgctccgcgccgaaggaagaggcggtgtccatcccgctggaccacggcaaccccacgccgagcctcaagcccgtgaccctgcagcaggtgctgccgaccgcggcgccgcgaagggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccatcggctcctagccgaagaccccggcgcaagtacggcgcggccagcctgctgatgcccaactacgcgctgcatccttccatcatccccacgcctggctaccgcggcacgcgcttctaccgcggtcatacaaccagccgccgccgcaagaccaccactcgccgccgccgtcgtcgcaccgccgctgcaactacccctgccgccttggtgcggagagtgtaccgccgcggccgcgcgcctctgaccctgccgcgcgcgcgctaccacccgagcatcgccatttaaaactttcgcctgctttgcagatggccctcacatgccgcctccgcgtccccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtgaaactgggtctgcccaccacgcggcccatcgcgcccctggccaccggggtgctgaaacccgaaagtagtaagcccgcgaccctggacttgcctcctcccgcttcccgcccctccacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcactgcctacaacagcctggcccccaagggagcacccaacacttgccagtggaaggactctgacaacaaaatgcatacctttggggtagctgccatgcccggtgttactgggaaaaagatagaagctgatgggctgcctattggaatagattcaacttctggaactgacaccataatttatgctgataaaactttccaacccgagccacaggttggaaatgacagttgggttgacaccaatggtgcagaggaaaaatatggaggcagagctctcaaggacactacaaatatgaaaccctgctatggttctttcgccaagcccaccaacaaagaaggtggtcaggctaacttaaaagattccgaaactgccaccaccactcctaactatgatatagatctggctttctttgacagcaaaaatatcgccgctaactacgatccagatattgtaatgtatacagaaaatgttgacctgcagactccagatactcatattgtatacaaacctggaacagaggacaccagctctgaatccaatttgggtcagcaggccatgcccaacagacccaactatattggtttcagggacaactttatcggtctcatgtactacaacagcactggcaatatgggggtgctggccggtcaggcctctcagctgaatgctgtggttgacttgcaagacagaaacaccgagctgtcctaccagctcttgcttgactctctgggtgacagaaccaggtatttcagtatgtggaatcaggcggtggacagctatgatcctgatgtgcgcattattgaaaaccatggtgtggaagatgaattgccaaactattgctttccattgaatggtgtgggatttacagatacttaccagggtgttaaagttaaaacagatgcaaatgctggaaacaatggaacacagtgggacaaagatgacaccacagttagcactgctaatgaaatccatggaggcaatccttttgccatggaaatcaacattcaggccaacctgtggcggaacttcctctatgccaacgtggccctctatttgcctgataaatacaaatacacacctgccaacatcaccctgcccaccaacaccaacacctacgattacatgaacggccgggtggtggcgccctcgctggtggacgcctacatcaacatcggggcgcgctggtcgctggaccccatggacaacgtgaatcccttcaaccaccaccgcaacgcggggctgcgctaccgctccatgcttctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctatcccatcccggccaacgccaccaacgtgcccatatccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaatgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccatacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaaattgcttcttgcaagctatggcctgtgccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaacaatcaagacatgtaaaccgtgtgtgtatgttaaaatgtctttaataaacagcactttcatgttacacatgcatctgagatggtttattatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccaggaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgcctgcccatggtgggcacgcagccgggcttgtggttgcaatcgcagtgcagggggatcagcatcatctgggcctggtcggcgttcatccccgggtacatggccttcatgaaagcctccaattgcctaaaagcctgctgggccttggctccctcggtgaagaagaccccgcaagacttgctagagaactggttggtagcgcacccggcgtcatgcacgcagcagcgcgcgtcgttgttggccagctgcaccacgctgcgcccccagcggttctgggtgatcttggcccggttggggttctccttcagcgcgcgctgcccgttctcgctcgccacatccatctcgatcatgtgctccttctggatcatggtggtcccgtgcaggcaccgcagcttgccctcggtctcggtgcaaccgtgcagccacagcgcgcacccggtgcactcccagttcttgtgggcgatctgtgaatgcgcgtgcacgaacccttgcaggaagcggcccatcatggtcgtcagggtcttgttgctagtgaaggtcagcggaatgccgcggtgctcctcgttgatgtacaggtggcagatgcggcggtacacctcgccctgctcgggcatcagctggaagttggctttcaggtcagtctccacgcggtagcggtccatcagtatagtcatgatttccatgcccttctcccaggccgagacgatgggcaggctcatagggttcttcaccatcatcttagcgctagccgccgcagccagggggtcgctctcgtccagggtctcaaagctccgcttgccgtccttctcggtgatccgcacgggggggtagctgaagcccacggccgccagctcctcctcggcctgcctttcgtcctcgctgtcctggctgacgtcctgcagaaccacatgcttggtcttgcggggtttcttcttgggtggcagtggcggcggagatgcttgcggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgatcgggggtgcgctcccggcggcgctctgactgacttcctccgcggccggccattgtgttctcctagggaacaacaagcatggagactcagccatcgccaacctcgccatctgcccccaccaccgccgacgagaagcagcagcagcagaatgaaagcttaaccgccccgccgcccagccccgccacctccgacgcggcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagaaaacgagcagagtcaggctgggctcgagcatggcgactacctccacctgagcgggggggaggacgcgctcatcaagcatctggcccggcaggccatcatcgtcaaggatgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttgaacctgggccccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagatgcaggaccccgagagctccgaggagggcaagcccgtggtcagcgacgagcagctggcccggtggctgggtcctaatgctacccctcagagtttggaagagcggcgcaagctcatgatggccgtggtcctggtgaccgtggagctggagtgtctgcgccgcttcttcgccgacgcggagaccctgcgcaaggtcgaggagaacctgcactacatcttcaggcacgggttcgtgcgccaggcctgcaagatttccaacgtggagctgaccaacctggtctcctacatgggcatcttgcacgagaaccgactggggcagaacgtgctgcacaccaccctgcgcggggaggcccggcgcgactacatccgcgactgcgtctacctctacctctgccacacctggcagacgggcatgggcgtgtggcagcagtgcctggaggagcagaacctgaaagagctctgcaagctcctgcagaagaacctcaagggtctgtggaccgggttcgacgagcgcaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggcgagggatcggccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcggccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtaaacttcccccgcaacatcttgcattactaccgtcacctccacagcccctactacttccaagaagaggcagcagcagaaaaagaccagcagaaaaccagcagcagctagaaaatccacagcggcggcagcgacaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccctcatcatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtgctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagccagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaatcggtcactgaccttcaccgggaacgagaccgagctccagctccagtgtaagccccacaagaagtacctcacctggctgtaccagggctccccgatcgccgttgttaaccactgcgacgacgacggagtcctgctgaacggtcccgccaaccttactttttccacccgcagaagcaagctcgagctcttccaacccttcctccccgggacctatcagtgcatctcgggaccctgccatcacaccttccacctgatcccgaataccacctcttccccagcgccgctccccactaacaaccaaactaaccaccaccaacgctaccgacgcgacctcgttgaatctaataccacccacaccggaggtgagctccgaggtcctgaatcctctgggatttattacggcccctgggaggtggtggggttaatagctttaggcttagtagcgggtgggcttttggctctctgctacctatacctcccttgcttttcctacttagtggtgctttgttgctggtttaagaaatggggaagatcaccctagtgtgcggtgtgctggtgacggtggtgctttcgattctgggagggggaagcgcggctgtagtgacggagaagaaggccgatccctgcttgactttcaaccccgataaatgccggctgagttttcagcccgatggcaatcggtgcgcggtgttgatcaagtgcggatgggaatgcgagagtgtggcgattcagtataaaaacaagacgcggaacaatactctcgcgtccacatggcagcccggggaccccgagtggtacaccgtctctgtccctggtgctgacggctccctccgcacggtgaacaacactttcatttttgagcacatgtgcgaaaccgccatgttcatgagcaagcagtacggtatgtggcctccacgaaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacacacttttttcacacacctttttcagaccatggcctctgttaaagttttgatcatagtcagtttaattgcttatgcctctggctatgcaaacattaaaaaaaccctctatgttggttctgactctatattagagggtacccaatccggagctaaggtttcatggtatttttatagaaccacaactgatccagttaaactctgtaagggtgaattaccacgcacgcataaaactccacttacattcagctgcagcaataataatcttacacttttttcggtcactaaacaatatgctggcacttactacagcacaaattttcatactgggcaagataaatactatactattacagtggccgatccaaccactcctagaactactactaaacccaccacaactaaaaagcccactacacctaaaaagcctaccacacccaaaaccactaagacaacaactaagaccactaccacagagccaaccacaaccagcaccacacttgctataactacacacacggagctgacctcacaagcaactactgaaaatggttttgccctattgcaaaagggggataacagtagcagcagtcctctgcctactacccccagtgaggaaatacctaagtccatggttggcattatcgctgccgtagtggtgtgtatgctgattatcatcttgtgcatgatgtactatgcctgctactacagaaaacacaggctgaacaataagctggaccccctactgaatgttgatttttaattttttagaaccatgaagatcctaagcctttttgttttttctataattattacctctgctctatgcaattccaacgatgacgttactgtcgttgttggatccaattacacactgaaaggacctccaaaaggtatgctttcgtggtattgctggtttggaaacgatgagcaacaaacagagctctgcaatcttaaaaatggaaaagtctcaaacccaaaaatctccaattatatatgcaatggcactgatttaatactgctcaatatcacgaaagcatatgctggcagttatacttgtcctggagacaatgatgacatgatttttaaaaaattgattgtggttgatcccactaccccagcaccacccaccacaactaccaaggcacataccacagacacacaggaaaccactccagaggcagaagtagcagagttagcaaagcagattcatgaagattcctttgttgccaatacccccacacaccccggaccgcaatgtccagggccattagtcagcggcattgtcggtgtgctttgcgggttagcagttataatcatctgcatgttcatttttgcttgctgctacagaaggctccaccgacaaaaatcagacccactgctgaacctctatgtttaatttttgattttccagagccatgaaggcacttagcactttagtatttttgtccttgattggcattgtattcagtgctgggtttttgaaaaatcttaccattattgaaggcgaaaatgcaacactggtaggcatcagtggtcagaatgttagctggttaaaataccatctagatgggtggaaacctatttgcacctggaatgtcagtgtgtacacatgccatggtgttaacctcaccattaccaatgccacccaagatcagaatggcaggtttaagggtcagagttttactagcaacaatgggtatgaaacccataacatgttcatctatgatgtcactgtcatatcaaataagactacacctaccacccagacacccactacacacagctcaacacatgccatgcagaccactcagacaaccacatacactacatccactgaacccaccaccactacagcagaggtaaccagcacagcgcctcagccccaggcattggctttaagggctgcacagtctagcagcatgactgctaaaaccaatgagcagactactgaatttttgtccactactcagagtcgcaccacagctacctcgagtgccttctctagcaccgccaatctcacctcgctttcctctatgccaatcagtaatgctactaccctccccgctcctcttcccactcctctgaagcaatccgagtctagcacgcagctgcagatcaccctgctcattgtgatcggggtggtcatcctggcagtgctgctctactttatcttctgccgccgcatccccaacgcgaaaccggcctacaagcccattgttatcgggacgccggagccgcttcaggtggagggaggtctaaggaatcttctcttctcttttacagtatggtgatttgaactatgattcctagacatttcattatcacttctctaatctgtgtgctccaagtctgtgccaccctcgctctcgtggctaacgcgagtccagactgcattggagcgttcgcctcctacgtgctctttgccttcatcacctgcatctgctgctgtagcatagtctgcctgcttatcaccttcttccagttcattgactgggtctttgtgcgcatcgcctacctgcgccaccatccccagtaccgcgaccagagagtggctcaactgttgaggctcatctgatgataagcatgcgggctctgctactactcgcgcttgcactagctcccctcgccgcccccttctccctcaaatcccccacccaatcccctgaagaggttcgaaaatgtaaattccaagaaccctggaaattcctcaaatgctaccagctcaaatcagaaatgcaccccagctggatcatgatcattggaatcgtgaacatccttgcctgtaccctcatctcctttgtgatttacccctgctttaactttgggtggaacgcacccgaggcgctctggctcccgcctgatcccgacacaccaccacagcagcagcaaaatcaggcacatgcaccaccacagcctaggccacaatacatgcccatcttagactatgaggccgagccacagcgagccatgcttcctgctattagttacttcaatctaaccggcggagatgactgaccccatggccaacaacaccgtcaacgacctcctggacatggacggccgcgcctcggagcagcgactcgcccaactccgcatccgccagcagcaggagagagccgtcaaggagctgcaggatgcggtggccatccaccagtgcaagagaggcatcttctgcctggtgaaacaggccaagatctccttcgaggtcacttccaccgaccatcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccctgatcaagaccctctgcggcctccgcgacctcctccccatgaactaatcaactaacccactacccctttaccctccagtaaaaataaagattaaagagttgatgattgaattgatcaataaagaatcacttacttgaaatctgaaaccaggtctctgtccatgttttctgccagcagcacttcactcccctcttcccagctctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaacggggctgtcaccctcaagctgggggatggggtggacctcgacgactcgggaaaactcatctccaaaaatgccaccaaggccactgcacctctcagtatttccaacggcaccatttcccttaacatggatacccctttttacaccagcgatggaaaattatccttacaagtttatccaccattaaacatattaagaacacccattatcaacacattagctttagcatataagtcaggtttaggtgtaagtgacaaatcccttgctgttcaattagcttctccactcacttttgatgaaaaaggaaatatagaaattaacttgggaagtgggccattaacagttgcatcaaatcaacttagcattaactgtcaaagaggtgtacatatcactactgcaggagatgcgcttgaaacaaacataagttgggctaaaggcataagatttgaaagtgatgccatagctgcaaacattggcaaaggattagaattcggaaccactagtacagagtccgatgtcacagatgcatttccaattcaagttaaattgggcactggccttacatttgacagcacaggagctattgttgcttggaacaaagaggatgacaagcttacactatggaccacagctgacccatctccaaactgtcacatatattctgcaaaagatgctaagcttactctctgtttaacaaagtgtggcagtcagatactgggcactgtttccctcatagctgttaatactggcagcttaaatccaataacgggaacagtacatactgctcttgtttcacttaaatttgatgcaagtggagttttgcaagccagttcaacattggacaaagaatattggaatttcagaaaagatgatgtaacacctgcagatccctacactaatgctataggttttatgcccaaccttaatgcatatccaaaaaacacaagtgcagctgcaaagagtcacattgtggggaaagtatacctcaatggtgatgtagccaaaccactggacttgataattacatttaatgaaaccagcgatgaaacctgtacctattgcattaactttcagtggcagtggggagctgatgaatataaaaatgaaacgcttgctgtcagttcattcaccttctcctacattgctaaagaataaaccctgcatgccaacccctttcccaactactatggaaaactctgaagcagaaaaaataaaagttcaagtgttttattgattcaacagttttcacagaattcgagtagttattttccctccaccctcccaactcatggaatacaccaccctctccccacgcacagccttaaacatctgaatgccattggtaatggacatggttttggtctccacattccacacagtttcagagcgagccagtctcgggtcggtcagggagatgaaaccctccgggcactcctgcatctgcacctcaaagttcagtagctgagggctgtcctcggtggtcgggatcacagttatctggaagaagagcgatgagagtcataatccgcgaacgggatcgggcggttgtggcgcatcagaccccgcagcagtcgctgtctgcgccgctccgtcaagctgctgctcaaagggtccgggtccagggactccctgcgcatgatgccgatggccctgagcatcagtcgcctggtgcggcgggcgcagcagcggatgcggatctcactcaggtcggagcagtacgtgcagcacagcaccaccaagttgttcaacagtccatagttcaacgtgctccagccaaaactcatctgtggaactatgctgcccacatgtccatcgtaccagatcctgatgtaaatcaggtggcgccccctccagaacacactgcccatgtacatgatctccttgggcatatgcaggttcaccacctcccggtaccacatcacccgctggttgaacatgcagccctggataattctgcggaaccagatggccagcaccgccccgcccgccatgcagcgcagggaccccgggtcctgacagtggcagtggaggacccaccgctcgcggccgtggatcaactgggagctgaacaggtctatgttggcacagcacaggcacacgctcatgcatgtcttcagcactctcagttcctcgggggtcaggaccatgtcccagggcacggggaactcttgcaggacagtgaacccggcagaacagggcagccctcgcacacaacttacattgtgcatggacagggtatcgcaatcaggcagcaccggatgatcctccaccagagaagcgcgggtctcggtctcctcacaacgaggtaagggggccggcggttggtacggatgatggcgggatgacgctaatcgtgttctggatcgtgtcatgatggagcttcttcctgacatcttcgtatttcatgtagcagaacctggtccgggcactgcacaccgctcgccggcgacggtctcggcgcttcgagcgctcggtgttgaagttgtaaaacagccactccctcagagcgtgcagtatctcttgagcctcttgggtgatgaaaatcccatccgccctgatggctctgatcacatcgaccacggtggaatgggccagacccagccagatgatgcaattttgttgggtttcggtgacggcgggggagggaagaacaggaagaaccatgattaactttattccaaacggtctcggagcacttcaaaatgcaggtcgcggagatggcacctctcgcccccactgtgttgatggaaaataacagccaggtcaaaggtgacacggttctcgagatgttccacggtggcttccagcaaagcctccacgcgcacatccagaaacaagaggacagcgaaagcgggagcgttctctaattcctcaatcatcatattacactcctgcaccatccccagataattttcatttttccagccttgaatgatttgaactagttcctgaggtaaatccaagccagccatgataaaaagctcgcgcagagcgccctccaccggcattcttaagcacaccctcataattccaagagattctgctcctggttcacctgcagcagattaacaaggggaatatcaaaatctctgccgcgatctctaagctcctccctcagcaataactgcaagtactctttcatatcttctccgaaatttttagccatagggccgccaggaatgagagcagggcaagccacattacagataaagcgaagtcctccccagtgagcattgccaaatgtaagattgaaataagcatgctggctagacccggtgatatcttccagataactggacagaaaatcaggcaagcaatttttaagaaaatcaacaaaagaaaagtcgtccaggtgcaagtttagagcctcaggaacaacgatggaataagtgcaaggagtgcgttccagcatggttagtgtttttttggtgatctgtagaacaaaaaataaacatgcaatattaaaccatgctagcctggcgaacaggtgggtaaatcactctttccagcaccaggcaggctacggggtctccggcgcgaccctcgtagaagctgtcgccatgattgaaaagcatcaccgaaagactttcccggtggccggcatggatgattcgcgaagacgcgtacactccgggaacattggcatccgtgagtgaaaaaaatcgccccaagaagccccgaggcactacaatgctcaaccttaattccagcagagcgaccccatgcggatgaagcacaaaattggtaggtgcgtaaaaaatgtaattactcccctcctgcacaggcagcaaagcccccgctccctccagaaacacatacaaagcctcagcgtccatagcttaccgagcacggcaggcgcaagattcagagaaaaggctgagctctaacctgactgcccgctcctgagctcaatatatagccctaacctacactgacgtaaaggccaaagtctaaaaatacccgccaaaatgacacacacgcccagcacacgcccagaaaccggtgacacactcaaaaaaatacgtgcgcttcctcaaacgcccaaaccggcgtcatttccgggttcccacgctacgtcaccgctcagcgactttcaaattccgtcgaccgttaaacacgtcactcgccccgcccctaacggtcgccctcctctcggccaatcaccttcctccatccccaaattcaaacggctcatttgcatattaacgcgcacaaaaagtttgaggtatattatttgatgatg

SEQ ID NO: 58 - protein, 184 aa, Unknown
  Synthetic Construct
MEIWTVLEDFHKTRQLLENASDGVSYLWRFCFGGDLAKLVYRAKQDYREQFEVILRECSGLFDALNLGHQSHFNQRISRALDFTTPGRTTAAVAFFAFLLDKWSQETHFSRDYQLDFLAVALWRTWKCQRLNAISGYLPVQPLDTLRILNLQESPRARQRRQQQQQEDQEENPRAGLDPPAEEE

SEQ ID NO: 59 - protein, 142 aa, Unknown; identical to SEQ ID NO: 3
  Synthetic Construct

SEQ ID NO: 60 - protein, 393 aa, Unknown
  Synthetic Construct
MHPVLRQMRPHHPPPQQQPPPPQPALLPPPQQQQQLPATTAAAAVSGAGQSYDHQLALEEGEGLARLGASSPERHPRVQMKRDAREAYVPKQNLFRDRSGEEPEEMRAARFHAGRELRRGLDRKRVLRDEDFEADELTGISPARAHVAAANLVTAYEQTVKEESNFQKSFNNHVRTLIAREEVTLGLMHLWDLLEAIVQNPTSKPLTAQLFLVVQHSRDNEAFREALLNITEPEGRWLLDLVNILQSIVVQERGLPLSEKLAAINFSVLSLGKYYARKIYKTPYVPIDKEVKIDGFYMRMTLKVLTLSDDLGVYRNDRMHRAVSASRRRELSDQELMHSLQRALTGAGTEGESYFDMGADLHWQPSRRALEAAGGPPYVEEVDEDEEGEYLED

SEQ ID NO: 61 - protein, 590 aa, Unknown
  Synthetic Construct
MQQQPPPDPAMRAALQSQPSGINSSDDWTQAMQRIMALTTRNPEAFRQQPQANRLSAILEAVVPSRYNPTHEKVLAIVNALVENKAIRGDEAGLVYNALLERVARYNSTNVQTNLDRMVTDVREAVAQRERFHRESNLGSMVALNAFLSTQPANVPRGQEDYTNFISALRLMVTEVPQSEVYQSGPDYFFQTSRQGLQTVNLSQAFKNLQGLWGVQAPVGDRATVSSLLTPNSRLLLLLVAPFTDSGSINRNSYLGYLINLYREAIGQAHVDEQTYQEITHVSRALGQDDPGNLEATLNFLLTNRSQKIPPQYALSAEEERILRYVQQSVGLFLMQEGATPSAALDMTARNMEPSMYASNRPFINKLMDYLHRAAAMNSDYFTNAILNPHWLPPPGFYTGEYDMPDPNDGFLWDDVDSSVFSPRPGANERPLWKKEGSDRRPSSALSGREGAAAAVPEAASPFPSLPFSLNSIRSSELGRITRPRLLGEEEYLNDSLLRPEREKNFPNNGIESLVDKMSRWKTYAQEHRDDPSQGATSRGSAARKRRWHDRQRGLMWDDEDSADDSSVLDLGGSGGNPFAHLRPRIGRMM

SEQ ID NO: 62 - protein, 534 aa, Unknown
  Synthetic Construct
MMRRAYPEGPPPSYESVMQQAMAAAAMQPPLEAPYVPPRYLAPTEGRNSIRYSELAPLYDTTRLYLVDNKSADIASLNYQNDHSNFLTTVVQNNDFTPTEASTQTINFDERSRWGGQLKTIMHTNMPNVNEFMYSNKFKARVMVSRKTPNGVTVGDDYDGSQDILEYEWVEFELPEGNFSVTMTIDLMNNAIIDNYLAVGRQNGVLESDIGVKFDTRNFRLGWDPVTELVMPGVYTNEAFHPDIVLLPGCGVDFTESRLSNLLGIRKRQPFQEGFQIMYEDLEGGNIPALLDVDAYEKSKEEAAAEATAAVATASTEVRGDNFASAAAVAAAEAAETESKIVIQPVEKDSKDRSYNVLPDKINTAYRSWYLAYNYGDPEKGVRSWTLLTTSDVTCGVEQVYWSLPDMMQDPVTFRSTRQVSNYPVVGAELLPVYSKSFFNEQAVYSQQLRAFTSLTHVFNRFPENQILVRPPAPTITTVSENVPALTDHGTLPLRSSIRGVQRVTVTDARRRTCPYVYKALGIVAPRVLSSRTF

SEQ ID NO: 63 - protein, 193 aa, Unknown; identical to SEQ ID NO: 6
  Synthetic Construct

SEQ ID NO: 64 - protein, 342 aa, Unknown
  Synthetic Construct
MSKRKFKEEMLQVIAPEIYGPAAAVKEERKPRKIKRVKKDKKEEDDVDGLVEFVREFAPRRRVQWRGRKVQPVLRPGTTVVFTPGERSGTASKRSYDEVYGDDDILEQAAERLGEFAYGKRSRSAPKEEAVSIPLDHGNPTPSLKPVTLQQVLPTAAPRRGFKREGEDLYPTMQLMVPKRQKLEDVLETMKVDPDVQPEVKVRPIKQVAPGLGVQTVDIKIPTEPMETQTEPVKPSTSTMEVQTDPWMPSAPSRRPRRKYGAASLLMPNYALHPSIIPTPGYRGTRFYRGHTTSRRRKTTTRRRRRRTAAATTPAALVRRVYRRGRAPLTLPRARYHPSIAI

SEQ ID NO: 65 - protein, 77 aa, Unknown
  Synthetic Construct
MALTCRLRVPITGYRGRKPRRRRLAGNGMRRHHHRRRRAISKRLGGGFLPALIPIIAAAIGAIPGIASVAVQASQRH

SEQ ID NO: 66 - protein, 258 aa, Unknown
  Synthetic Construct
MDSDAPGPVMCFRRQMEDINFSSLAPRHGTRPFMGTWSDIGTSQLNGGAFNWSSLWSGLKNFGSTLKTYGSKAWNSTTGQALREKLKEQNFQQKVVDGLASGINGVVDLANQAVQRQINSRLDPVPPAGSVEMPQVEEELPPLDKRGEKRPRPDAEETLLTHTDEPPPYEEAVKLGLPTTRPIAPLATGVLKPESSKPATLDLPPPASRPSTVAKPLPPVAVARARPGGTARPHANWQSTLNSIVGLGVQSVKRRRCY

SEQ ID NO: 67 - protein, 940 aa, Unknown
  Synthetic Construct
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNTCQWKDSDNKMHTFGVAAMPGVTGKKIEADGLPIGIDSTSGTDTIIYADKTFQPEPQVGNDSWVDTNGAEEKYGGRALKDTTNMKPCYGSFAKPTNKEGGQANLKDSETATTTPNYDIDLAFFDSKNIAANYDPDIVMYTENVDLQTPDTHIVYKPGTEDTSSESNLGQQAMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLNGVGFTDTYQGVKVKTDANAGNNGTQWDKDDTTVSTANEIHGGNPFAMEINIQANLWRNFLYANVALYLPDKYKYTPANITLPTNTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 68 - protein, 209 aa, Unknown
  Synthetic Construct
MACATGSGEQELRAIIRDLGCGPYFLGTFDKRFPGFMAPHKLACAIVNTAGRETGGEHWLAFAWNPRSNTCYLFDPFGFSDERLKQIYQFEYEGLLRRSALATEDRCVTLEKSTQTVQGPRSAACGLFCCMFLHAFVHWPDRPMDKNPTMNLLTGVPNGMLQSPQVEPTLRRNQEALYRFLNSHSAYFRSHRARIEKATAFDRMNNQDM

SEQ ID NO: 69 - protein, 807 aa, Unknown
  Synthetic Construct
METQPSPTSPSAPTTADEKQQQQNESLTAPPPSPATSDAAVPDMQEMEESIEIDLGYVTPAEHEEELAVRFQSSSQEDKEQPEQEAENEQSQAGLEHGDYLHLSGGEDALIKHLARQAIIVKDALLDRTEVPLSVEELSRAYELNLFSPRVPPKRQPNGTCEPNPRLNFYPVFAVPEALATYHIFFKNQKIPVSCRANRTRADALLNLGPGARLPDIASLEEVPKIFEGLGSDETRAANALQGEGGEHEHHSALVELEGDNARLAVLKRTVELTHFAYPALNLPPKVMSAVMDQVLIKRASPISEDEMQDPESSEEGKPVVSDEQLARWLGPNATPQSLEERRKLMMAVVLVTVELECLRRFFADAETLRKVEENLHYIFRHGFVRQACKISNVELTNLVSYMGILHENRLGQNVLHTTLRGEARRDYIRDCVYLYLCHTWQTGMGVWQQCLEEQNLKELCKLLQKNLKGLWTGFDERTTASDLADLIFPERLRLTLRNGLPDFMSQSMLQNFRSFILERSGILPATCSALPSDFVPLTFRECPPPLWSHCYLLRLANYLAYHSDVIEDVSGEGLLECHCRCNLCTPHRSLACNPQLLSETQIIGTFELQGPSDEGEGSAKGGLKLTPGLWTSAYLRKFVPEDYHPFEIRFYEDQSQPPKAELSACVITQGAILAQLQAIQKSRQEFLLKKGRGVYLDPQTGEELNPGFPQDAPRKQEAESGAAARGGFGGRLGEQQSGRGGGDGGRLGQHSGRGGQPARQSGGRRGGGRGGGGRSSRRQTVVLGGGESKQHGYHLRSGSGSRSAPQ

SEQ ID NO: 70 - protein, 227 aa, Unknown
  Synthetic Construct
MSKEIPTPYMWSYQPQMGLAAGAAQDYSTRMNWLSAGPAMISRVNDIRAHRNQILLEQSALTATPRNHLNPRNWPAALVYQEIPQPTTVLLPRDAQAEVQLTNSGVQLAGGATLCRHRPAQGIKRLVIRGRGTQLNDEVVSSSLGLRPDGVFQLAGSGRSSFTPRQAVLTLESSSSQPRSGGIGTLQFVEEFTPSVYFNPFSGSPGHYPDEFIPNFDAISESVDGYD

SEQ ID NO: 71 - protein, 106 aa, Unknown
  Synthetic Construct
MSHGGAADLARLRHLDHCRRFRCFARDLAEFTYFELPEEHPQGPAHGVRIVVEGGLDSHLLRIFSQRPILVERQQGNTLLTLYCICDHPGLHESLCCLLCTEYNKS

SEQ ID NO: 72 - protein, 176 aa, Unknown
  Synthetic Construct
MGKITLVCGVLVTVVLSILGGGSAAVVTEKKADPCLTFNPDKCRLSFQPDGNRCAVLIKCGWECESVAIQYKNKTRNNTLASTWQPGDPEWYTVSVPGADGSLRTVNNTFIFEHMCETAMFMSKQYGMWPPRKENIVVFSIAYSACTVLITAIVCLSIHMLIAIRPRNNAEKEKQP

SEQ ID NO: 73 - protein, 243 aa, Unknown
  Synthetic Construct
MASVKVLIIVSLIAYASGYANIKKTLYVGSDSILEGTQSGAKVSWYFYRTTTDPVKLCKGELPRTHKTPLTFSCSNNNLTLFSVTKQYAGTYYSTNFHTGQDKYYTITVADPTTPRTTTKPTTTKKPTTPKKPTTPKTTKTTTKTTTTEPTTTSTTLAITTHTELTSQATTENGFALLQKGDNSSSSPLPTTPSEEIPKSMVGIIAAVVVCMLIIILCMMYYACYYRKHRLNNKLDPLLNVDF

SEQ ID NO: 74 - protein, 207 aa, Unknown
  Synthetic Construct
MKILSLFVFSIIITSALCNSNDDVTVVVGSNYTLKGPPKGMLSWYCWFGNDEQQTELCNLKNGKVSNPKISNYICNGTDLILLNITKAYAGSYTCPGDNDDMIFKKLIVVDPTTPAPPTTTTKAHTTDTQETTPEAEVAELAKQIHEDSFVANTPTHPGPQCPGPLVSGIVGVLCGLAVIIICMFIFACCYRRLHRQKSDPLLNLYV

SEQ ID NO: 75 - protein, 291 aa, Unknown
  Synthetic Construct
MKALSTLVFLSLIGIVFSAGFLKNLTIIEGENATLVGISGQNVSWLKYHLDGWKPICTWNVSVYTCHGVNLTITNATQDQNGRFKGQSFTSNNGYETHNMFIYDVTVISNKTTPTTQTPTTHSSTHAMQTTQTTTYTTSTEPTTTTAEVTSTAPQPQALALRAAQSSSMTAKTNEQTTEFLSTTQSRTTATSSAFSSTANLTSLSSMPISNATTLPAPLPTPLKQSESSTQLQITLLIVIGVVILAVLLYFIFCRRIPNAKPAYKPIVIGTPEPLQVEGGLRNLLFSFTVW

SEQ ID NO: 76 - protein, 91 aa, Unknown
  Synthetic Construct
MIPRHFIITSLICVLQVCATLALVANASPDCIGAFASYVLFAFITCICCCSIVCLLITFFQFIDWVFVRIAYLRHHPQYRDQRVAQLLRLI

SEQ ID NO: 77 - protein, 146 aa, Unknown
  Synthetic Construct
MISMRALLLLALALAPLAAPFSLKSPTQSPEEVRKCKFQEPWKFLKCYQLKSEMHPSWIMIIGIVNILACTLISFVIYPCFNFGWNAPEALWLPPDPDTPPQQQQNQAHAPPQPRPQYMPILDYEAEPQRAMLPAISYFNLTGGDD

SEQ ID NO: 78 - protein, 442 aa, Unknown
  Synthetic Construct
MSKKRARVDDGFDPVYPYDADNAPTVPFINPPFVSSDGFQEKPLGVLSLRLADPVTTKNGAVTLKLGDGVDLDDSGKLISKNATKATAPLSISNGTISLNMDTPFYTSDGKLSLQVYPPLNILRTPIINTLALAYKSGLGVSDKSLAVQLASPLTFDEKGNIEINLGSGPLTVASNQLSINCQRGVHITTAGDALETNISWAKGIRFESDAIAANIGKGLEFGTTSTESDVTDAFPIQVKLGTGLTFDSTGAIVAWNKEDDKLTLWTTADPSPNCHIYSAKDAKLTLCLTKCGSQILGTVSLIAVNTGSLNPITGTVHTALVSLKFDASGVLQASSTLDKEYWNFRKDDVTPADPYTNAIGFMPNLNAYPKNTSAAAKSHIVGKVYLNGDVAKPLDLIITFNETSDETCTYCINFQWQWGADEYKNETLAVSSFTFSYIAKE

SEQ ID NO: 79 - DNA, 30070 bp, Unknown
  Simian adenovirus A1295
  CDS (7)..(1494): E1b\55K
  CDS (23633)..(24196): 22K
  CDS (25511)..(26143): E3\CR1-alpha
  CDS (29668)..(30069): E3\14.7K
tgacaaatggagtcaagaaacccatttcagcagggattaccagctggatttcttagcagtagctttgtggagaacatggaagtgccagcgcctgaatgcaatctcaggctacttgccggtacagccgctagacactctgaggatcctgaatctccaggagagtcccagggcacgccaacgtcgccagcagcagcagcaggaggatcaagaagagaacccgagagccggcctggaccctccggcggaggaggagtagctgacctgtttcctgaactgcgccgggtgctgactaggtcttcgagtggtcgggagagggggattaagcgggagaggcatgatgagactaatcacagaactgaactgactgtgggtctgatgagccgtaagaggccagaaacagtgtggtggcatgaggtgcagtcgactggcacagatgaggtgtcagtcatgcatgagaagttttccctagaacaagtcaagacttgttggttggagcctgaggatgattgggaggtagccatcaggaattatgccaagctggctctcaggccagacaagaagtacaagattactaagctgataaatatcagaaatgcctgctacatctcagggaatggggctgaagtggagatctgtcttcaggatagagtggctttcagatgctgtatgatgaatatgtacccgggagtggtgggcatggatggggtcacctttatgaacatgaggttcaggggagatgggtataatggcacggtctttatggccaatacgaagctgacagtccatggctgctccttctttgggtttaataacacctgcattgaggcctggggtcaggtcggtgtgaggggctgcagtttttcagccaactggatgggggtcgtgggcaggaccaaaagtgtgctgtccgtgaagaaatgcttgtttgagaggtgccacctgggggtgatgagcgagggcgaagccagaatccgccactgcgcctctaccgagacgggctgcttcgtgctgtgcaagggcaatgctaagatcaagcataatatgatttgtggagcctcggacgagcgcggctaccagatgctgacctgcgccagtgggaacagccatatgctggccaccgtgcatgtggcttcccattcccgcaagccctggcctgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcggggaggacctgcatgagggccagaatgactgaaatctgtgcttttctgtgtgttgcagcagcatgagcggaagcggctcctttgagggaggggtattcagcccttatctgacggggcgtctcccctcatgggcgggagtgcgtcagaatgtgatgggatccacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggattttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttagaagggaaggcgtgaaagaatttggcgacgcccttgtgcccgcccaggttttccatgcactcatccatgatgatggcgatgggcccgtgggcggcggcctgggcaaaaacgtttcgggggtcggacacatcatagttgtggtcctgggtgagatcatcataggccattttaatgaatttggggcggagggtgcctgactgggggacaaaggtaccctcgatcccgggggcgtagttcccctcgcagatctgcatctcccaggctttgagctcggagggggggatcatgtccacctgcggggcgataaagaacacggtttccggggcgggggagatgagctgcgccgaaagcaagttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcatccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcttcgagcggtgtgccacggtcctcctcgtagaggaaccccgcccactccgagacgaaagcccgggtccaggccagcacgaaggaggccacgtgggacgggtagcggtcgttgtccaccagcgggtccactttttccagggtatgcaaacacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagtttggtggcgaaggagccgtagagggcgttggaaaggagcttggcgatagagcgcatggtctggttcttttccttgtctgcgcgctccttggccgcgatgttgagctgcacgtactcgcgcgccacgcacttccattcggggaagacggtggtcagctcgtcgggcacgattctgacctgccagccccggttatgcagggtgataaggtccacactggtggccacctcgccgcgcaggggctcattagtccagcagaggcgcccgcccttgcgcgagcagaaggggggcagggggtcgagcatgacctcgtcgggggggtcggcatcgatggtgaagatgccgggcaggagatcggggtcaaagtagctgatggaagtggccagatcgtccagggcagcttgccattcgcgcacggccagcgcgcgctcgtaggggctgaggggcgtgccccagggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggcgcgaggagccccgggcccaggttggtgcgactgggcttttcggcgcggtagacgatctggcgaaagatggcatgcgagttggaggagatggtgggcctttggaagatgttgaagtgggcgtgggggagaccgaccgagtcgcggatgaagtgggcgtaggagtcttgcagcttggcgacgagctcggcggtgacgaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaggtgtccctgaccatgactttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaacggttggggcacctcggcccggttgttgatgacctgggcggcgagcacgatctcgtcgaaaccgttgatgttgtggcccacgatgtaaagttccacgaatcgcgggcggcccttgacgtggggcagtttcttgagctcctcgtaggtgagctcgtcggggtcgctgaggccgtgctgctcgagcgcccagtcggcgagatgggggttggcgcggaggaaggaagtccagagatccacggccagggcggtctgcaggcggtcccggtactgacgaaactgctgcccgacggccattttttcgggggtgacgcagtagaaggtgcgggggtccccgtgccaacgatcccatttgagctggagggcaagatcgagggcgagctcgacgaggcggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggtgtgaccaccgtcccccgtttcttcttgggcggctggggaggcggtgcctcttccatggttagaagcggcggcgaggacgcgcgccgggcggcaggggcggctctgggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtaaaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggttggagggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcctgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggccggatgaaactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgttttttgtttttgccagatgcatcccgtactgcggcagatgcgcccccaccaccctccaccgcaacaacagccccctcctccacagccggcgcttctgcccccgccccagcagcagcagcaacttccagccacgaccgccgcggccgccgtgagcggggctggacagagttatgaccaccagctggccttggaagagggcgaggggctggcgcgcctgggggcgtcgtcgccggagcggcacccgcgcgtgcagatgaaaagggacgctcgtgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcacagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcaggcggtcccccctacgtagaagaggtggacgaggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctacaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgatgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgctctgcgcctgatggtgaccgaggtgccccagagcgaggtgtaccagtccgggccggactacttcttccagaccagtcgccagggcttgcagaccgtgaacctgagccaggctttcaagaacttgcagggattgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacttgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataagctgatggactacttgcatcgggcggccgccatgaactcggactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgtcgcccgtcctcggcgctgtccggccgggagggtgctgccgcggcggtgcccgaggccgccagtcctttcccgagcttgcccttctcgctgaacagtattcgcagcagcgagctgggcaggatcacgcgtccgcgcttgctgggcgaggaggagtacttgaatgactcgctgttgagacccgagcgggagaaaaacttccccaacaacgggatagagagcctggtggacaagatgagccgctggaagacgtatgcgcaggagcacagggacgatccgtcgcagggggccacgagccggggcagcgcggcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgtttagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaacggggtcacagtaggggatgactatgatggtagtcaggatatcttggagtatgaatgggtggagtttgagctgcccgaaggcaacttctcggtgaccatgaccatcgacctgatgaacaacgccatcatcgacaattacttggcggtggggcggcagaacggggtgctcgagagcgacatcggcgtgaagttcgacaccaggaacttcaggctgggctgggaccccgtgaccgagctggtcatgccaggggtgtacaccaacgaggccttccatcccgatattgtcttgctgcccggctgcggggtggacttcaccgagagccgcctcagcaacctgctgggcattcgcaagaggcagcccttccaggagggtttccagatcatgtacgaggatctggaggggggcaacatccccgcgctcctggatgtcgacgcctatgagaaaagcaaggaggaagcagcagctgaagcaactgcagcggtagccaccgcctctaccgaggtcaggggcgataattttgcaagcgctgcggcagtggcagcggccgaggcggctgaaaccgaaagtaagatagtcattcagccggtggagaaggatagcaaggacaggagctacaacgtgctgccggacaagataaacaccgcctaccgcagctggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctttcgagccgcaccttctaaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccccgcggcggcggtgaaggaggaaagaaagccccgcaaaatcaagcgggtcaaaaaggacaaaaaggaagaagatgatgtggacggattggtggagtttgtgcgcgagttcgcccccaggcggcgcgtgcagtggcgcgggcggaaggtgcaaccggtgctgagacccggcaccaccgtggttttcacgccaggcgagcgctccggcaccgcctccaagcgctcctacgacgaggtgtacggggatgatgatattctggaacaggcggccgagcgcctgggcgagtttgcttacggcaagcgcagccgctccgcgccgaaggaagaggcggtgtccatcccgctggaccacggcaaccccacgccgagcctcaagcccgtgaccctgcagcaggtgctgccgaccgcggcgccgcgaagggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccatcggctcctagccgaagaccccggcgcaagtacggcgcggccagcctgctgatgcccaactacgcgctgcatccttccatcatccccacgcctggctaccgcggcacgcgcttctaccgcggtcatacaaccagccgccgccgcaagaccaccactcgccgccgccgtcgtcgcaccgccgctgcaactacccctgccgccttggtgcggagagtgtaccgccgcggccgcgcgcctctgaccctgccgcgcgcgcgctaccacccgagcatcgccatttaaaactttcgcctgctttgcagatggccctcacatgccgcctccgcgtccccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtgaaactgggtctgcccaccacgcggcccatcgcgcccctggccaccggggtgctgaaacccgaaagtagtaagcccgcgaccctggacttgcctcctcccgcttcccgcccctccacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcactgcctacaacagcctggcccccaagggagcacccaacacttgccagtggaaggactctgacaacaaaatgcatacctttggggtagctgccatgcccggtgttactgggaaaaagatagaagctgatgggctgcctattggaatagattcaacttctggaactgacaccataatttatgctgataaaactttccaacccgagccacaggttggaaatgacagttgggttgacaccaatggtgcagaggaaaaatatggaggcagagctctcaaggacactacaaatatgaaaccctgctatggttctttcgccaagcccaccaacaaagaaggtggtcaggctaacttaaaagattccgaaactgccaccaccactcctaactatgatatagatctggctttctttgacagcaaaaatatcgccgctaactacgatccagatattgtaatgtatacagaaaatgttgacctgcagactccagatactcatattgtatacaaacctggaacagaggacaccagctctgaatccaatttgggtcagcaggccatgcccaacagacccaactatattggtttcagggacaactttatcggtctcatgtactacaacagcactggcaatatgggggtgctggccggtcaggcctctcagctgaatgctgtggttgacttgcaagacagaaacaccgagctgtcctaccagctcttgcttgactctctgggtgacagaaccaggtatttcagtatgtggaatcaggcggtggacagctatgatcctgatgtgcgcattattgaaaaccatggtgtggaagatgaattgccaaactattgctttccattgaatggtgtgggatttacagatacttaccagggtgttaaagttaaaacagatgcaaatgctggaaacaatggaacacagtgggacaaagatgacaccacagttagcactgctaatgaaatccatggaggcaatccttttgccatggaaatcaacattcaggccaacctgtggcggaacttcctctatgccaacgtggccctctatttgcctgataaatacaaatacacacctgccaacatcaccctgcccaccaacaccaacacctacgattacatgaacggccgggtggtggcgccctcgctggtggacgcctacatcaacatcggggcgcgctggtcgctggaccccatggacaacgtgaatcccttcaaccaccaccgcaacgcggggctgcgctaccgctccatgcttctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctatcccatcccggccaacgccaccaacgtgcccatatccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaatgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccatacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaaattgcttcttgcaagctatggcctgtgccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaacaatcaagacatgtaaaccgtgtgtgtatgttaaaatgtctttaataaacagcactttcatgttacacatgcatctgagatggtttattatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccaggaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgcctgcccatggtgggcacgcagccgggcttgtggttgcaatcgcagtgcagggggatcagcatcatctgggcctggtcggcgttcatccccgggtacatggccttcatgaaagcctccaattgcctaaaagcctgctgggccttggctccctcggtgaagaagaccccgcaagacttgctagagaactggttggtagcgcacccggcgtcatgcacgcagcagcgcgcgtcgttgttggccagctgcaccacgctgcgcccccagcggttctgggtgatcttggcccggttggggttctccttcagcgcgcgctgcccgttctcgctcgccacatccatctcgatcatgtgctccttctggatcatggtggtcccgtgcaggcaccgcagcttgccctcggtctcggtgcaaccgtgcagccacagcgcgcacccggtgcactcccagttcttgtgggcgatctgtgaatgcgcgtgcacgaacccttgcaggaagcggcccatcatggtcgtcagggtcttgttgctagtgaaggtcagcggaatgccgcggtgctcctcgttgatgtacaggtggcagatgcggcggtacacctcgccctgctcgggcatcagctggaagttggctttcaggtcagtctccacgcggtagcggtccatcagtatagtcatgatttccatgcccttctcccaggccgagacgatgggcaggctcatagggttcttcaccatcatcttagcgctagccgccgcagccagggggtcgctctcgtccagggtctcaaagctccgcttgccgtccttctcggtgatccgcacgggggggtagctgaagcccacggccgccagctcctcctcggcctgcctttcgtcctcgctgtcctggctgacgtcctgcagaaccacatgcttggtcttgcggggtttcttcttgggtggcagtggcggcggagatgcttgcggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgatcgggggtgcgctcccggcggcgctctgactgacttcctccgcggccggccattgtgttctcctagggaacaacaagcatggagactcagccatcgccaacctcgccatctgcccccaccaccgccgacgagaagcagcagcagcagaatgaaagcttaaccgccccgccgcccagccccgccacctccgacgcggcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagaaaacgagcagagtcaggctgggctcgagcatggcgactacctccacctgagcgggggggaggacgcgctcatcaagcatctggcccggcaggccatcatcgtcaaggatgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttgaacctgggccccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagatgcaggaccccgagagctccgaggagggcaagcccgtggtcagcgacgagcagctggcccggtggctgggtcctaatgctacccctcagagtttggaagagcggcgcaagctcatgatggccgtggtcctggtgaccgtggagctggagtgtctgcgccgcttcttcgccgacgcggagaccctgcgcaaggtcgaggagaacctgcactacatcttcaggcacgggttcgtgcgccaggcctgcaagatttccaacgtggagctgaccaacctggtctcctacatgggcatcttgcacgagaaccgactggggcagaacgtgctgcacaccaccctgcgcggggaggcccggcgcgactacatccgcgactgcgtctacctctacctctgccacacctggcagacgggcatgggcgtgtggcagcagtgcctggaggagcagaacctgaaagagctctgcaagctcctgcagaagaacctcaagggtctgtggaccgggttcgacgagcgcaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggcgagggatcggccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcggccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtaaacttcccccgcaacatcttgcattactaccgtcacctccacagcccctactacttccaagaagaggcagcagcagaaaaagaccagcagaaaaccagcagcagctagaaaatccacagcggcggcagcgacaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccctcatcatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtgctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagccagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaatcggtcactgaccttcaccgggaacgagaccgagctccagctccagtgtaagccccacaagaagtacctcacctggctgtaccagggctccccgatcgccgttgttaaccactgcgacgacgacggagtcctgctgaacggtcccgccaaccttactttttccacccgcagaagcaagctcgagctcttccaacccttcctccccgggacctatcagtgcatctcgggaccctgccatcacaccttccacctgatcccgaataccacctcttccccagcgccgctccccactaacaaccaaactaaccaccaccaacgctaccgacgcgacctcgttgaatctaataccacccacaccggaggtgagctccgaggtcctgaatcctctgggatttattacggcccctgggaggtggtggggttaatagctttaggcttagtagcgggtgggcttttggctctctgctacctatacctcccttgcttttcctacttagtggtgctttgttgctggtttaagaaatggggaagatcaccctagtgtgcggtgtgctggtgacggtggtgctttcgattctgggagggggaagcgcggctgtagtgacggagaagaaggccgatccctgcttgactttcaaccccgataaatgccggctgagttttcagcccgatggcaatcggtgcgcggtgttgatcaagtgcggatgggaatgcgagagtgtggcgattcagtataaaaacaagacgcggaacaatactctcgcgtccacatggcagcccggggaccccgagtggtacaccgtctctgtccctggtgctgacggctccctccgcacggtgaacaacactttcatttttgagcacatgtgcgaaaccgccatgttcatgagcaagcagtacggtatgtggcctccacgaaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacacacttttttcacacacctttttcagaccatggcctctgttaaagttttgatcatagtcagtttaattgcttatgcctctggctatgcaaacattaaaaaaaccctctatgttggttctgactctatattagagggtacccaatccggagctaaggtttcatggtatttttatagaaccacaactgatccagttaaactctgtaagggtgaattaccacgcacgcataaaactccacttacattcagctgcagcaataataatcttacacttttttcggtcactaaacaatatgctggcacttactacagcacaaattttcatactgggcaagataaatactatactattacagtggccgatccaaccactcctagaactactactaaacccaccacaactaaaaagcccactacacctaaaaagcctaccacacccaaaaccactaagacaacaactaagaccactaccacagagccaaccacaaccagcaccacacttgctataactacacacacggagctgacctcacaagcaactactgaaaatggttttgccctattgcaaaagggggataacagtagcagcagtcctctgcctactacccccagtgaggaaatacctaagtccatggttggcattatcgctgccgtagtggtgtgtatgctgattatcatcttgtgcatgatgtactatgcctgctactacagaaaacacaggctgaacaataagctggaccccctactgaatgttgatttttaattttttagaaccatgaagatcctaagcctttttgttttttctataattattacctctgctctatgcaattccaacgatgacgttactgtcgttgttggatccaattacacactgaaaggacctccaaaaggtatgctttcgtggtattgctggtttggaaacgatgagcaacaaacagagctctgcaatcttaaaaatggaaaagtctcaaacccaaaaatctccaattatatatgcaatggcactgatttaatactgctcaatatcacgaaagcatatgctggcagttatacttgtcctggagacaatgatgacatgatttttaaaaaattgattgtggttgatcccactaccccagcaccacccaccacaactaccaaggcacataccacagacacacaggaaaccactccagaggcagaagtagcagagttagcaaagcagattcatgaagattcctttgttgccaatacccccacacaccccggaccgcaatgtccagggccattagtcagcggcattgtcggtgtgctttgcgggttagcagttataatcatctgcatgttcatttttgcttgctgctacagaaggctccaccgacaaaaatcagacccactgctgaacctctatgtttaatttttgattttccagagccatgaaggcacttagcactttagtatttttgtccttgattggcattgtattcagtgctgggtttttgaaaaatcttaccattattgaaggcgaaaatgcaacactggtaggcatcagtggtcagaatgttagctggttaaaataccatctagatgggtggaaacctatttgcacctggaatgtcagtgtgtacacatgccatggtgttaacctcaccattaccaatgccacccaagatcagaatggcaggtttaagggtcagagttttactagcaacaatgggtatgaaacccataacatgttcatctatgatgtcactgtcatatcaaataagactacacctaccacccagacacccactacacacagctcaacacatgccatgcagaccactcagacaaccacatacactacatccactgaacccaccaccactacagcagaggtaaccagcacagcgcctcagccccaggcattggctttaagggctgcacagtctagcagcatgactgctaaaaccaatgagcagactactgaatttttgtccactactcagagtcgcaccacagctacctcgagtgccttctctagcaccgccaatctcacctcgctttcctctatgccaatcagtaatgctactaccctccccgctcctcttcccactcctctgaagcaatccgagtctagcacgcagctgcagatcaccctgctcattgtgatcggggtggtcatcctggcagtgctgctctactttatcttctgccgccgcatccccaacgcgaaaccggcctacaagcccattgttatcgggacgccggagccgcttcaggtggagggaggtctaaggaatcttctcttctcttttacagtatggtgatttgaactatgattcctagacatttcattatcacttctctaatctgtgtgctccaagtctgtgccaccctcgctctcgtggctaacgcgagtccagactgcattggagcgttcgcctcctacgtgctctttgccttcatcacctgcatctgctgctgtagcatagtctgcctgcttatcaccttcttccagttcattgactgggtctttgtgcgcatcgcctacctgcgccaccatccccagtaccgcgaccagagagtggctcaactgttgaggctcatctgatgataagcatgcgggctctgctactactcgcgcttgcactagctcccctcgccgcccccttctccctcaaatcccccacccaatcccctgaagaggttcgaaaatgtaaattccaagaaccctggaaattcctcaaatgctaccagctcaaatcagaaatgcaccccagctggatcatgatcattggaatcgtgaacatccttgcctgtaccctcatctcctttgtgatttacccctgctttaactttgggtggaacgcacccgaggcgctctggctcccgcctgatcccgacacaccaccacagcagcagcaaaatcaggcacatgcaccaccacagcctaggccacaatacatgcccatcttagactatgaggccgagccacagcgagccatgcttcctgctattagttacttcaatctaaccggcggagatgactgaccccatggccaacaacaccgtcaacgacctcctggacatggacggccgcgcctcggagcagcgactcgcccaactccgcatccgccagcagcaggagagagccgtcaaggagctgcaggatgcggtggccatccaccagtgcaagagaggcatcttctgcctggtgaaacaggccaagatctccttcgaggtcacttccaccgaccatcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccctgatcaagaccctctgcggcctccgcgacctcctccccatgaact

SEQ ID NO: 80 - protein, 496 aa, Unknown
  Synthetic Construct
MESRNPFQQGLPAGFLSSSFVENMEVPAPECNLRLLAGTAARHSEDPESPGESQGTPTSPAAAAGGSRREPESRPGPSGGGGVADLFPELRRVLTRSSSGRERGIKRERHDETNHRTELTVGLMSRKRPETVWWHEVQSTGTDEVSVMHEKFSLEQVKTCWLEPEDDWEVAIRNYAKLALRPDKKYKITKLINIRNACYISGNGAEVEICLQDRVAFRCCMMNMYPGVVGMDGVTFMNMRFRGDGYNGTVFMANTKLTVHGCSFFGFNNTCIEAWGQVGVRGCSFSANWMGVVGRTKSVLSVKKCLFERCHLGVMSEGEARIRHCASTETGCFVLCKGNAKIKHNMICGASDERGYQMLTCASGNSHMLATVHVASHSRKPWPEFEHNVMTRCNMHLGSRRGMFMPYQCNLNYVKVLLEPDAMSRVSLTGVFDMNVEVWKILRYDESKTRCRACECGGKHARFQPVCVEVTEDLRPDHLVLSCTGTEFGSSGEESD

SEQ ID NO: 81 - protein, 188 aa, Unknown
  Synthetic Construct
MPRGNKKLKVELPPVEDLEEDWENSSQAEEEEMEEDWDSTQAEEDSLQDSLEEDEEEAEEEVEEAAAARPSSSAGEKASSTDTISAPGRGPARPHSRWDETGRFPNPTTQTGKKERQGYKSWRGHKNAIVSCLQACGGNISFTRRYLLFHRGVNFPRNILHYYRHLHSPYYFQEEAAAEKDQQKTSSS

SEQ ID NO: 82 - protein, 211 aa, Unknown
  Synthetic Construct
MKVFVVCCVLSIIKAEISDYSGLNCGVSASINRSLTFTGNETELQLQCKPHKKYLTWLYQGSPIAVVNHCDDDGVLLNGPANLTFSTRRSKLELFQPFLPGTYQCISGPCHHTFHLIPNTTSSPAPLPTNNQTNHHQRYRRDLVESNTTHTGGELRGPESSGIYYGPWEVVGLIALGLVAGGLLALCYLYLPCFSYLVVLCCWFKKWGRSP

SEQ ID NO: 83 - protein, 134 aa, Unknown
  Synthetic Construct
MTDPMANNTVNDLLDMDGRASEQRLAQLRIRQQQERAVKELQDAVAIHQCKRGIFCLVKQAKISFEVTSTDHRLSYELLQQRQKFTCLVGVNPIVITQQSGDTKGCIHCSCDSPECVHTLIKTLCGLRDLLPMN

SEQ ID NO: 84 - DNA, 880 bp, Unknown
  Simian adenovirus A1295
  CDS (7)..(571): E1a
  CDS (665)..(870): E1a
tgaaagatgaggcacctgagagacctgcccgatgagaaaatcatcatcgcttccgggaacgagattctggaactggtggtaaatgccatgatgggcgacgaccctccggagccccccaccccatttgagacaccttcgctacacgatttgtatgatctggaggtggatgtgcccgaggacgaccccaacgaggaggcggtaaatgatttatttagcgatgccgcactgctagctgccgaggaggcttcgagccctagctcagacagcgactcttcactgcatacccctagacccggcagaggtgagaaaaagatccccgagcttaaaggggaagagatggacttgcgctgctatgaggaatgcttgcccccgagcgatgatgaggacgagcaggcgatccagaacgtagcgagccagggagtgcaagccgccagcgagagctttgcgctggactgcccgcctctgcccggacacggctgtaagtcttgtgaatttcatcgcttgaatactggagataaagctgtgttatgtgcactttgctatatgagagcttacaaccattgtgtttacagtaagtgtgattaagttgaactttagagggaggcagagagcggggtgactgggcgatgactggtttatttatgtatatatgttctttatataggtcccgtctctgacgcagatgatgagacccccactacagagtccatttcgtcacccccagaaattggcacatctccacctgagaatattgttagaccagttcctgttagagccactgggaggagagcagctgtggaatgtttggatgacttgctacagggtggggatgaacctttggacttgtgtacccggaaacgccccaggcactaagtgccac

SEQ ID NO: 85 - protein, 257 aa, Unknown
  Synthetic Construct
MRHLRDLPDEKIIIASGNEILELVVNAMMGDDPPEPPTPFETPSLHDLYDLEVDVPEDDPNEEAVNDLFSDAALLAAEEASSPSSDSDSSLHTPRPGRGEKKIPELKGEEMDLRCYEECLPPSDDEDEQAIQNVASQGVQAASESFALDCPPLPGHGCKSCEFHRLNTGDKAVLCALCYMRAYNHCVYSPVSDADDETPTTESISSPPEIGTSPPENIVRPVPVRATGRRAAVECLDDLLQGGDEPLDLCTRKRPRH

SEQ ID NO: 86 - DNA, 36528 bp, Unknown
  Simian adenovirus A1309
  repeat_region (1)..(129): ITR
  CDS (1599)..(2177): E1b\19K
  CDS (3456)..(3926): pIX
  misc_feature (3991)..(5612): IVa2   complement (3991..5321,5600..5612)
  misc_feature (5094)..(13857): pol    complement (5094..8660,13849..13857)
  misc_feature (8462)..(13857): pTP   complement (8462..10393,13849..13857)
  CDS (10850)..(12022): 52K
  CDS (12049)..(13815): pIIIa
  CDS (13897)..(15516): penton
  CDS (15523)..(16104): pVII
  CDS (16152)..(17195): V
  CDS (17223)..(17453): pX
  CDS (17525)..(18253): pVI
  CDS (18348)..(21164): hexon
  CDS (21189)..(21809): protease
  misc_feature (21898)..(23433): DBP   complement (21898...23433)
  CDS (23456)..(25843): 100K
  CDS (26469)..(27149): pVIII
  CDS (27153)..(27470): E3\12.5K
  CDS (28035)..(28565): E3\gp19K
  CDS (28598)..(29215): E3\CR1-beta
  CDS (29231)..(29845): E3\CR1-gamma
  CDS (29863)..(30741): E3\CR1-delta
  CDS (31033)..(31464): E3\RID=beta
  CDS (32137)..(33411): fiber
  misc_feature (33523)..(34676): E4\orf6/7   complement (33523..33774,34506..34676)
  misc_feature (33774)..(34676): E4\orf6   complement (33774..34676)
  misc_feature (34585)..(34947): E4\orf4   complement (34585..34947)
  misc_feature (34960)..(35310): E4\orf3   complement (34960..35310)
  misc_feature (35310)..(35696): E4\orf2   complement (35310..35696)
  misc_feature (35739)..(36110): E4\orf1   complement (35739..36110)
  repeat_region (36400)..(36528): ITR   complement (36400..36528)
catcatcaataatatacctcaaacttttggtgcgcgttaatatgcaaatgaggtatttgaatttggggatgcggggcggtgattggctgcgggagcggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaattccgcgtttatggcagggaggagtatttgccgagggccgagtagactttgaccgattacgtgggggtttcgattaccgtatttttcacctaaatttccgcgtacggtgtcaaagtccggtgtttttacgtaggtgtcagctgatcgccagggtatttaaacctgcgctctctagtcaagaggccactcttgagtgccagcgagtagagttttctcctccgcgccgcgagtcagatctacactttgaaagatgaggcacctgagagacctgcccggtaatgttttcctggctactgggaacgagattctggaactggtggtggacgccatgatgggtgacgaccctccggagccccctaccccatttgaagcgccttcgctgtacgatttgtatgatctggaggtggatgtgcccgagaacgaccccaacgaggaggcggtgaatgatttgtttagcgatgccgcgctgctggctgccgagcaggctaatacggactctggctcagacagcgattcctctctccataccccgagacccggcagaggtgagaaaaagatccccgagcttaaaggggaagagctcgacctgcgctgctatgaggaatgcttgcctccgagcgatgatgaggaggacgaggaggcgattcgagctgcagcgaaccagggagtgaaaacagcgagcgagggctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagctggggaggcagagggtgactgggtgctgactggtttatttatgtatatgttttttatgtgtaggtcccgtctctgacgtagatgagacccccactacagagtgcatttcatcacccccagaaattggcgaggaaccgcccgaagatattattcatagaccagttgcagtgagagtcaccgggcgtagagcagctgtggagagtttggatgacttgctacagggtggggatgaacctttggacttgtgtacccggaaacgccccaggcactaagtgccacacatgtgtgtttacttaaggtgatgtcagtatttatagggtgtggagtgcaataaaatccgtgttgactttaagtgcgtggtttatgactcaggggtggggactgtgggtatataagcaggtgcagacctgtgtggtcagttcagagcaggactcatggagatctggacagtcttggaagactttcaccagactagacagctgctagagaactcatcggagggagtctcttacctgtggagattctgcttcggtggggctctagctaagctagtccatagggccaaacaggattataaggatcaatttgaggatattttgagagagtgtcctggtatttttgactctctcaacttgggccatcagtctcactttaaccagagtattctgagagcccttgacttttcaactcctggcagaactaccgccgcggtagccttttttgcctttatccttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagtcaccccaggaacaccaacgccgccagcagccgcagcaggagcagcagcaagaggaggaggaggaggaccgagaagagaacccgagagccggtctggaccctccggtggcggaggaggaggagtagctgacttgtttcccgagctgcgccgggtgctgactaggtcttccagtggacgggagagggggattaagcgggagaggcatgaggagactagccatagaactgaactgactgtcagtctgatgagccgcaggcgtccagaatcggtgtggtggcatgaggttcagtcgcaggggatagatgaggtctcagtgatgcatgagaaatattccctagaacaagtcaagacttgttggttggagcctgaggatgattgggaggtagccatcaggaattatgccaagctagcgctgaagccagacaagaagtacaagattaccaagttgattaatatcagaaattcctgctacatttcagggaatggggccgaggtggagatcagtacccaggagagggtggccttcagatgctgcatgatgaatatgtacccgggggtggtgggcatggagggagtcacctttatgaacgcgaggttcaggggtgatgggtataatggggtggtctttatggccaacaccaagctgacagtgcacggatgctccttctttggcttcaataacatgtgcatcgaggcctggggcagtgtttcagtgaggggatgcagcttttcagccaactggatgggggttgtgggcagaaccaagagcatggtgtcagtgaagaaatgtctgttcgagaggtgccacctgggggtgatgagcgagggcgaagccaaagtcaaacactgcgcctctaccgagacgggctgctttgtgctgatcaagggcaatgccaaagtcaagcataacatgatctgtggggcctctgatgagcgcggctaccagatgctgacctgcgccggtgggaacagccatatgctggccactgtgcatgtgtcctcgcacccccgcaagacatggcccgagttcgagcacaacgtcatgacccgctgcaatgtgcacctgggctcccgccgaggcatgttcatgccctaccagtgcaacatgcaatttgtgaaggtgctgctggagcccgatgccatgtccagagtgagcctggcgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggaggtggagggcctgcatgaggggcagaatgactaaaatctgtgtttttctgcgcagcagcatgagcggaagcgcctcctttgagggaggggtattcagcccttatctgacggggcgtctcccctcctgggctggagtgcgtcagaatgtgatgggatccacggtggacggccggcccgtgcagcccgcgaactcttcaaccctgacctacgcgaccctgagctcctcgtccgtggacgcagctgccgccgcagctgctgcttcagccgccagcgccgtgcgcggaatggccctgggcgccggctactacagctctctggtggccaactcgagttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctattgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtggccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagcccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccaggggcgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtacagcttgggggcgaggaagacggactcgggggcgtaggcgtccgcgccgcagctggcgcagacggtctcgcactccacgagccaggtgaggtcggggcggtcggggtcaaaaacgaggtttcctccgtgctttttgatgcgtttcttacctctggtctccatgagctcgtgtccccgctgggtgacaaagaggctgtccgtgtccccgtagaccgactttatgggtcggtcttcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagatcgtccagcgccgcttgccagtcgcgcacggccagcgcgcgctcgtaggggctgaggggcgtgccccagggcatggggtgtgtgagcgcggaggcgtacatgccgcagatgtcgtagacgtagaggggctcttcgaggacgccgatgtaggtggggtagcagcgccccccgcggatgctggcgcgcacgtagtcgtacagctcgtgcgagggcgcgaggagccccgtgccgagattggagcgctgcggcttttcggcgcggtagacgatctggcggaagatggcgtgggagttggaggagatggtgggcctctggaagatgttgaagtgggcgtggggcaggccgaccgagtccctgatgaagtgggcgtaggagtcttgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaagcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagagcccagtcggcgaggtgggggttggcactgaggaaggaagaccagagatccacggccagggcggtctgcaagcggtcccggtactgacggaactgccggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctcgtgctgtactacgtcctggccatcggcgtggccatcgtctgcctcgatggtggtcatgctgacgaggccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgttttttcttgggcgctggcggcggcggctccatgcttagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtagaagtccacggcgaagttgaaaaactgggagttgcgcgccgagacggtcaactcctcctccagaagacggatgagctcggcgatggtggcgcgcacctcgcgctcgaaggccccggggggctcctcctcttccatctcctcctcctcttcctcctccactaacatctcttctacttcctcctcaggaggcggcggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattgacccgtagggactccgcgcaaggacctgagcgtctcgagatccacgggatccgaaaaccgctgaacgaaggcttcgagccagtcgcagtcgcaaggtaggctgagcccggtttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctgtggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgttcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgttttggcaattttcgtcaggccggaaatgaaactagtaagcgcggaaagcggccgcccgcgatggctcgctgccgtagtctggagaaagaatcgccagggttgcgttgcggtgtgccccggttcgagactcagcgctcggcgccggccggattccgcggctaacgtgggcgtggctgccccgtcgtttccaagaccccttagccagccgacttctccagttacggagcgagcccctctttttcttgtgtttttgccagatgcatcccgtactgcggcagatgcgcccccaccctccaccacaaccgcccctaccgcagcagcagcaacagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggatcgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcacgctgatcgcgcgcgaggaggtgaccctgggcctgatgcacctgtgggacctgctggaggccattgtgcagaatcccacgagcaagccgctgacggcgcagctgtttctggtggtgcagcacagtcgggacaacgagacgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagcctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggcgtgccctacgtggaggaggtggacgatgaggaggaggagggcgagtacctggaagactgatggcgcgaccgtatttttgctagatgcagcaacagccaccgccgccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggcgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcgggcaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgccgcgctcgacatgaccgcgcgcaacatggagcccagcatgtacgcccgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgccccaccaccaccgtgtggaagaaagagggcggggaccggcggccgtcctcggcgctgtccggtcgcgcgggtgctgccgcggcggtgcccgaggccgccagccccttcccgagcctgcccttttcgctgaacagcgtgcgcagcagcgagctgggtcggctgacgcggccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcagcgcaggcgccacccgtagacgccagcggcacgacaggcagcggggtctggtgtgggacgatgaggattccgccgacgacagcagcgtgttggacttgggtgggagtggtggtggtaacccgttcgctcacctgcgcccccgcatcgggcgcctgatgtaagaatctgaaaaaataaaaaacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaacggggtcacggtaggggatgattatgatggtagtcaggacgagctgacctacgagtgggtggagtttgagctgcccgagggcaacttctcggtgaccatgaccatcgatctgatgaacaacgccatcatcgacaactacttggcggtggggcggcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctacgagaaaagcaaggaggatagcgccgcagcggcgaccgcagccgtggctaccgccgcgactgtggcagatgccactgtcaccaggggcgatacattcgccacccaggcggaggaagcagccgccctagcggcgaccgatgatagtgaaagtaagatagttatcaagccggtggagaaggacagcaaggacaggagctacaacgttctatcggatggaaagaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaattcaaggaagagatgctccaggtcatcgcgcctgagatctacggcccggctgcggtgaaggaggaaagaaagccccgcaaactgaagcgggtcaaaaaggacaaaaaggaggaggaagatgacggactggtggagtttgtgcgcgagttcgccccccggcggcgcgtgcagtggcgcgggcggaaagtgaaaccggtgctgcgacccggcaccacggtggtcttcacgcccggcgagcgttccggctccgcctccaagcgctcctacgacgaggtgtacggggacgaggacatcctcgagcaggcggccgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggtgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcgccggcctccaccaccaccactcgccgaagacgcaagtacggcgcggccagcctgctgatgcccaactacgcgctgcatccttccatcatccccacgccgggctaccgcggcacgcgcttctaccgcggctacaccagcagcagccgccgcaagaccaccacccgccgccgccgtcgtcgcacccgccgcagcagcaccgcgacttccgccgccgccctggtgcggagagtgtaccgcagcgggcgcaagcctctgaccctgccgcgcgcgcgctaccacccgagcatcgccatttaactctgccgtcgcctccttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggtctgcccaccacgcgccccgtggcgcctctggccaccggggtgctgaaacccagcagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtgtatatgtatgtccgccgaccagaaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccccagcttcaaaccctactccggcaccgcctacaacagcctggctcccaaggctgctcctaatccgagccagtgggaagaaaccactgcaggaacaaatgggaatgccgatgccactactaccactcatagctttggactggctgctatgaagggggacaacattacatctgatggtttgcagataggaacggatgctagttctggagaagaaaaacccatctatgcagataaactgtaccagccagaaccccaaataggggaagagtcatggaccgatactgatggaaccaatgaaaaatttggaggaagagtccttaaaaaggacacaagcatgaagccttgctatgggtcatttgccaaacccactaataacaaaggtggacaggcaaaacaaaaggcaactgaaggaactgatatagagtatgatgttgacatgaaatttttcgatggtagggatgcggctgctaactttactccagaagtagtgttgtatgctgaaaatgttgatctggaaactccagatacccacattgtatacaaaccaggaacctctgatgtaagttcccatgttaatttgggacaacagtctatgcccaacagacccaactacattggcttcagagacaactttatcggtctcatgtactacaacagcactggcaatatgggtgtactggctggtcaggcctcccagctgaatgctgtggtggacttgcaggacagaaacaccgaactgtcctaccagctcttgcttgactctctgggtgacagaaccaggtatttcagtatgtggaatcaggcggtggacagctatgaccccgatgtgcgcattattgaaaaccatggtatagaagacgaacttcccaactattgcttccctctggatgctgtgggtattaccagaacctatcaaggcatcaaattgcaaaatggtcaaactaccacctgggaaaaggatgacagcgttagcactgccaatgaaataggaattggcaacaatctggccatggagatcaacatccaggccaacctgtggcggaacttcctctacgcgaacgtggccctgtacctgcccgactcctacaagtacacgccggccaacatcacgctgccgaccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccattccggccaacgccaccaacgtgcccatctccatcccctcgcgcaactgggccgccttccgcggctggtcattcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagagggatacaacgtggctcagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagccgctcttgcttcttgcaagatgacggcctgtggctccggcgagcaggagctcagggccatcctccgcgacctgggctgcgggccctacttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaaaaaaccggtgtgtgtatgtgaatgctttattcataataaacagcacatgtttatgccaccttttctgaggctctgactttatttagaaatcgaaggggttctgccggctctcggcatgccccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcacagttgggacccgcgttctgcgcgcgagagttgcggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagcccgcgtcgtgcacgcagcagcgcgcgtcgttgttggccagctgcaccacgctgcgcccccagcggttctgggtaatcttggcccggtcggggttctccttcagcgcgcgctgcccgttctcgctcgccacatccatctcgatcgtgtgctccttctggatcatcacggtcccgtgcaggcaccgcagcttgccctcggcctcggtgcagccgtgcagccacagcgcgcagccggtgcactcccagttcttgtgggcgatctgggagtgcgagtgcacgaagccctgcaggaagcggcccatcatcgtagtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgtcatcttagtcgccgccgccgaggtcagggggtcgttctcgtccagggtttcaaacactcgcttgccgtccttctcggtgatgcgcacggggggaaagctgaagcccacggccgccagctcctcctcggcctgcctttcgtcctcgctgtcctggctgatgtcttgtaaaggcacatgcttggtcttgcggggtttctttttgggcggcagaggcggcggcggcggagacgtgctgggcgagcgcgagttctcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaagcatggagactcagccatcgtcgccaacatcgccatctgcccccgccgccgacgagaaccagcagcagaatgaaagcttaaccgccccgccgcccagccccacctccgacgcggccccagacatgcaagagatggaggaatccatcgagattgacctgggctacgtgacgcccgcggagcacgaggaggagctggcagcgcgcttttcagccccggaagagaaccaccaagagcagccagagcaggaagcagagagcgagcagcagcaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacctctttttcaagaatcaaaggatccccgtctcctgccgcgccaaccgcacccgcgccgacgccctactcaacctgggccccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtactcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgtctggaggagcagaacctgaaagagctctgcaagctcctgcagaagaacctcaaggccctgtggaccgggttcgacgagcgcaccaccgccgcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacctgctgcgtctggctaactacctggcctaccactcggacgtgatcgaggacgtcagcggcgagggtctgctcgagtgccactgccgctgcaacctctgcacgccgcaccgctccctggcctgcaacccccagctgctgagcgagacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggtcgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccggaggatttggaggaagactgggagagcagtcaggcagaggaggagatggaagactgggacagcactcaggcagaggaggacagcctgcaagacagtctggaggaggaagacgaggtggaggaggaggcagaggaagaagcagccgccgccagaccgtcgtcctcggcggaggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagaaaaccagcggcagcagcagctagaaaatccacggcggcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcggctgacctagctcggcttcgacacctggaccactgccgccgcttccgctgcttcgctcgggatctcgccgagtttgcctactttgagctgcccgaggagcaccctcagggtccggcccacggagtgcggatcatcgtcgaagggggcctcgactcccacctgcttcggatcttcagccagcgaccgatcctggtcgagcgcgagcaaggacagacccgtctgaccctgtattgcatctgcaaccaccccggcctgcatgaaagtctttgttgtctgctgtgtactgagtataataaaagctgagatcagcgactactctggactcgattgtggtgttcctgctatcaaccggtccctgttcttcaccggaaacgagaccgagctccagctccagtgtaagccccacaagaagtacctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcggcgctccccgctactaacaaccaaactacccaccaacgccaccgtcgcgacctttcctctgaatctaataccacccacaccggaggtgagctccgaggtcgaccaacctctgggatttactacggcccctgggaggtggtggggttaatagcgctaggcctagttgcgggtgggcttttggttctctgctacctatacctcccttgctgttcgtacttagtggtgctgtgttgctggtttaagaaatggggaagatcaccctagtgagctgcggtgcgctggtggcggtggtgctttcgattatgggactgggcggcgcggctgtagtgaaggaggagaaggccgatccctgcttgcatttcaatcccgacaaatgccagctgagttttcaggccgatggcaatcggtgcgcggtgctgatcaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaataatactttcatttttgcacacatgtgcgacacggtcatgtggatgagcaagcagtacgatatgtggccccccacgaaggagaacatcgtggtcttctccatcgcttacagcctgtgcacggtgctaatcaccgctatcgtgtgcctgagcattcacatgctcatcgctattcgccccagaaataatgccgagaaagaaaaacagccataacacgttttttcacacacctttttcagaccatggcctctgttaaatttttgcttttatttgccagtctcattgccgtcattcatggaatgagtaatgagaaaattactatttacactggcactaatcacacattgaaaggtccagaaaaagccacagaagtttcatggtattgttattttaatgaatcagatgtatctactgaactctgtggaaacaataacaaaaaaaatgagagcattactctcatcaagtttcaatgtggatctgacttaaccctaattaacatcactagagactatgtaggtatgtattatggaactacagcaggcatttcggacatggaattttatcaagtttctgtgtctgaacccaccacgcctagaatgaccacaaccacaaaaactacacctactaccaccacacagctcactaccaatggctttcttgccatgcttcgagtggctgaaaatagcaccagcattcaacccaccccacccagtgaggaaattcccagatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctaggccttttagttttttctatcattacctctgctctatgcaattctgacaatgaggacgttactgtcgttgtcggatcaaattatacactgaaaggtccagcgaagggtatgctttcgtggtattgctattttggatctgacactacagaaactgaattatgcaatcttaagaatggcaaaattcaaaattctaaaattaacaattatatatgcaatggtactgatctgatactcctcaatgtcacgaaagcatattctggcagctacacctgccctggagatgatgctgacaatatgattttttacaaagtggaagtggttgatcccactactccacctccacccaccaccacaaccactcataccacacacacagaacaaaccacagcagaggaggtagcaaagttagccttgcaggtccaaggcagttcatttgttggcattacccctacacccgatcagcggtgtccggggctgctcgtcagcggcattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcactctagttttttgttctttgattggcactgtttttagtgttagctttttgaaacaaattaatgttactgagggggaaaatgtgacactggtaggcgtagaaggtgctcaaaataccacctggacaaaataccacctcgatgggtggaaagatatttgcaattggagtgtcattacttacacatgtgagggagttaatttgaccatagtcaatgccagccaaaatcagaagggttggattaaagggcaatctgttagtgttaccagtgaggggtactatacccagcatactcttatctatgacattatagtcataccgctgcctacgcctagcccacctagcactaccacacagacaacccacactacacacacaaccacatacagtacatcaaatcagcctaccaccactacagcagcagaggttgccagctcgtctggagtccaagtggcatttttgttgttgcccccatctagcagtcccactgctagtaccaatgagcagactactgaatttttgtccactgtcgagagccacaccgcagctacctccagtgccttctctagcaccgccaatctctcctcgctttcctctacaccaatcagtcccgctactactactcctacccccgctcttctccccactcccctgaagcaaactgaggacggcggcatgcaatggcagatcaccctgctcattgtgatcgggttggtcatcctggccgtgttgctctactacatcttctgccgccgcattcccaacgcgcaccgcaagccggtctacaagcccatcgttgtcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcatcacctgcatctgctgctgtagcatagtctgcctgcttatcaccttcttccagttcattgactggatctttgtgcgcatcgcctacctgcgccaccacccccagtaccgcgaccagcgagtggcgcggctgctcaggatcctctgataagcatgcgggctctgctacttctcgcgcttctgctgttagtgctcccccgtcccgtcgacccccggacccccacccagtcccccgaggaggtccgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcaacctcaggcacacgcactaccaccaccaccacagcctaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaaaaaataatcatttgatttgaaataaagatacaatcatattgatgatttgagtttaacaaaaataaagaatcacttacttgaaatctgataccaggtctctgtccatattttctgccaacaccacctcactcccctcttcccagctctggtactgcaggccccggcgggctgcaaacttcctccacacgctgaaggggatgtcaaattcctcctgcccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgactcctcgggaaaactcatctccaacacggccaccaaggccgctgcccctctcagtttttccaacaacaccatttcccttaacatggatcaccccttttacactaaagatggaaaattagccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgtcgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatatgccaatgctgtaggattcatgcccaatttaaaagcttatccaaagtcacaaagttctactactaaaaataatatagtagggcaagtatacatgaatggagatgtttcaaaacctatgcttctcactataaccctcaatggtactaatgacagcaacagtacatattcaatgtcattttcatacacctggactaatggaagctatgttggagcaacatttggagctaactcttataccttctcctacatcgcccaagaatgaatactgtatcccaccctgcatgcccaaccctcccccacctctgtctatatggaaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgccccctccagaacacgctgcccatgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcagctcctcgggggtcaaaaccatatcccagggcacgggaaactcttgcaggacagcgaagcccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgatcgtgtcatgatgcagttgctttcggacattttcgtacttgctgtagcagaacctggtccgggcgctgcacaccgatcgccggcggcggtcccggcgcttggaacgctcggtgttgaagttgtaaaacagccactctctcagaccgtgcagcagatctagggcctcaggagtgatgaaaatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaaggtcgcggagatggcacctctcgcccccgctgtgttggtggaaaataacagccaggtcaaaggtgatacggttctcgagatgttccacggtggcttccagcaaagcctccacgcgcacatccagaaacaagacaatagcaaaagcgggagggttctctaattcctcaatcatcatgttacactcctgcaccatccccagataattttcatttttccagccttgaatgattcgaactagttcctgaggtaaatccaagccagccattataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccgccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtgcacgtttagagcctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgtccctcataaaaattgtcgctatgattgaaaaccatcacagagagacgttcccggtggccggcgtgaatgattcgacaagacgaatacacccccggaacattggcgtccgcgagtgaaaaaaagcgcccaaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcagcggcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaacacgactttcaaattccgtcgaccgttaaaaacgtcacccgccccgcccctaacggtcgccgctcccgcagccaatcaccgccccgcatccccaaattcaaatacctcatttgcatattaacgcgcaccaaaagtttgaggtatattattgatgatg

SEQ ID NO: 87 - protein, 193 aa, Unknown
  Synthetic Construct
MEIWTVLEDFHQTRQLLENSSEGVSYLWRFCFGGALAKLVHRAKQDYKDQFEDILRECPGIFDSLNLGHQSHFNQSILRALDFSTPGRTTAAVAFFAFILDKWSQETHFSRDYRLDCLAVALWRTWRCQRLNAISGYLPVQPVDTLRILSLQSPQEHQRRQQPQQEQQQEEEEEDREENPRAGLDPPVAEEEE

SEQ ID NO: 88 - protein, 157 aa, Unknown
  Synthetic Construct
MRGRMTKICVFLRSSMSGSASFEGGVFSPYLTGRLPSWAGVRQNVMGSTVDGRPVQPANSSTLTYATLSSSSVDAAAAAAAASAASAVRGMALGAGYYSSLVANSSSTNNPASLNEEKLLLLMAQLEALTQRLGELTQQVAQLQAETRAAVATVKTK

SEQ ID NO: 89 - protein, 391 aa, Unknown
  Synthetic Construct
MHPVLRQMRPHPPPQPPLPQQQQQPALLPPPQQQQPATTAAAAVSGAGVQYDLALEEGEGLARLGASSPERHPRVQMKRDAREAYVPKQNLFRDRSGEEPEEMRASRFHAGRELRRGLDRKRVLRDEDFEADELTGISPARAHVAAANLVTAYEQTVKEESNFQKSFNNHVRTLIAREEVTLGLMHLWDLLEAIVQNPTSKPLTAQLFLVVQHSRDNETFREALLNITEPEGRWLLDLVNILQSIVVQERGLPLSEKLAAINFSVLSLGKYYARKIYKTPYVPIDKEVKIDGFYMRMTLKVLTLSDDLGVYRNDRMHRAVSASRRRELSDQELMHSLQRALTGAGTEGESYFDMGADLRWQPSRRALEAAGGVPYVEEVDDEEEEGEYLED

SEQ ID NO: 90 - protein, 589 aa, Unknown
  Synthetic Construct
MQQQPPPPPPDPAMRAALQSQPSGINSSDDWTQAMQRIMALTTRNPEAFRQQPQANRLSAILEAVVPSRSNPTHEKVLAIVNALVENKAIRGDEAGLVYNALLERVARYNSTNVQTNLDRMVTDVREAVSQRERFHRESNLGSMVALNAFLSTQPANVPRGQEDYTNFISALRLMVAEVPQSEVYQSGPDYFFQTSRQGLQTVNLSQAFKNLQGLWGVQAPVGDRATVSSLLTPNSRLLLLLVAPFTDSGSVSRDSYLGYLLNLYREAIGQAHVDEQTYQEITHVSRALGQEDPGNLEATLNFLLTNRSQKIPPQYALSTEEERILRYVQQSVGLFLMQEGATPSAALDMTARNMEPSMYARNRPFINKLMDYLHRAAAMNSDYFTNAILNPHWLPPPGFYTGEYDMPDPNDGFLWDDVDSSVFSPRPTTTVWKKEGGDRRPSSALSGRAGAAAAVPEAASPFPSLPFSLNSVRSSELGRLTRPRLLGEEEYLNDSLLRPEREKNFPNNGIESLVDKMSRWKTYAHEHRDEPRASSSAGATRRRQRHDRQRGLVWDDEDSADDSSVLDLGGSGGGNPFAHLRPRIGRLM

SEQ ID NO: 91 - protein, 540 aa, Unknown
  Synthetic Construct
MMRRVYPEGPPPSYESVMQQAVAAAMQPPLEAPYVPPRYLAPTEGRNSIRYSELAPLYDTTRLYLVDNKSADIASLNYQNDHSNFLTTVVQNNDFTPTEASTQTINFDERSRWGGQLKTIMHTNMPNVNEFMYSNKFKARVMVSRKTPNGVTVGDDYDGSQDELTYEWVEFELPEGNFSVTMTIDLMNNAIIDNYLAVGRQNGVLESDIGVKFDTRNFRLGWDPVTELVMPGVYTNEAFHPDIVLLPGCGVDFTESRLSNLLGIRKRQPFQEGFQILYEDLEGGNIPALLDVEAYEKSKEDSAAAATAAVATAATVADATVTRGDTFATQAEEAAALAATDDSESKIVIKPVEKDSKDRSYNVLSDGKNTAYRSWYLAYNYGDPEKGVRSWTLLTTSDVTCGVEQVYWSLPDMMQDPVTFRSTRQVSNYPVVGAELLPVYSKSFFNEQAVYSQQLRAFTSLTHVFNRFPENQILVRPPAPTITTVSENVPALTDHGTLPLRSSIRGVQRVTVTDARRRTCPYVYKALGVVAPRVLSSRTF

SEQ ID NO: 92 - protein, 194 aa, Unknown; identical to SEQ ID NO: 34
  Synthetic Construct

SEQ ID NO: 93 - protein, 348 aa, Unknown
  Synthetic Construct
MSKRKFKEEMLQVIAPEIYGPAAVKEERKPRKLKRVKKDKKEEEDDGLVEFVREFAPRRRVQWRGRKVKPVLRPGTTVVFTPGERSGSASKRSYDEVYGDEDILEQAAERLGEFAYGKRSRPAPLKEEAVSIPLDHGNPTPSLKPVTLQQVLPSAAPRRGFKREGGEDLYPTMQLMVPKRQKLEDVLEHMKVDPEVQPEVKVRPIKQVAPGLGVQTVDIKIPTEPMETQTEPVKPSTSTMEVQTDPWMPAPASTTTTRRRRKYGAASLLMPNYALHPSIIPTPGYRGTRFYRGYTSSSRRKTTTRRRRRRTRRSSTATSAAALVRRVYRSGRKPLTLPRARYHPSIAI

SEQ ID NO: 94 - protein, 77 aa, Unknown; identical to SEQ ID NO: 36
  Synthetic Construct

SEQ ID NO: 95 - protein, 243 aa, Unknown
  Synthetic Construct
MEDINFSSLAPRHGTRPFMGTWSDIGNSQLNGGAFNWSSLWSGLKNFGSTLKTYGNKAWNSSTGQALREKLKEQNFQQKVVDGLASGINGVVDLANQAVQKQINSRLDAVPPAGSVEMPQVEEELPPLDKRGDKRPRPDAEETLLTHTDEPPPYEEAVKLGLPTTRPVAPLATGVLKPSSSSSQPATLDLPPPASRPSTVAKPLPPVAVASRAPRGRPQANWQSTLNSIVGLGVQSVKRRRCY

SEQ ID NO: 96 - protein, 939 aa, Unknown
  Synthetic Construct
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKAAPNPSQWEETTAGTNGNADATTTTHSFGLAAMKGDNITSDGLQIGTDASSGEEKPIYADKLYQPEPQIGEESWTDTDGTNEKFGGRVLKKDTSMKPCYGSFAKPTNNKGGQAKQKATEGTDIEYDVDMKFFDGRDAAANFTPEVVLYAENVDLETPDTHIVYKPGTSDVSSHVNLGQQSMPNRPNYIGFRDNFIGLMYYNSTGNMGVLAGQASQLNAVVDLQDRNTELSYQLLLDSLGDRTRYFSMWNQAVDSYDPDVRIIENHGIEDELPNYCFPLDAVGITRTYQGIKLQNGQTTTWEKDDSVSTANEIGIGNNLAMEINIQANLWRNFLYANVALYLPDSYKYTPANITLPTNTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 97 - protein, 207 aa, Unknown
  Synthetic Construct
MTACGSGEQELRAILRDLGCGPYFLGTFDKRFPGFMAPHKLACAIVNTAGRETGGEHWLAFAWNPRSHTCYLFDPFGFSDERLKQIYQFEYEGLLRRSALATEDRCVTLEKSTQTVQGPRSAACGLFCCMFLHAFVHWPDRPMDKNPTMNLLTGVPNGMLQSPQVEPTLRRNQEALYRFLNAHSAYFRSHRARIEKATAFDRMNQDM

SEQ ID NO: 98 - protein, 796 aa, Unknown
  Synthetic Construct
METQPSSPTSPSAPAADENQQQNESLTAPPPSPTSDAAPDMQEMEESIEIDLGYVTPAEHEEELAARFSAPEENHQEQPEQEAESEQQQAGLEHGDYLSGAEDVLIKHLARQCIIVKDALLDRAEVPLSVAELSRAYERNLFSPRVPPKRQPNGTCEPNPRLNFYPVFAVPEALATYHLFFKNQRIPVSCRANRTRADALLNLGPGARLPDIASLEEVPKIFEGLGSDETRAANALQGSGEEHEHHSALVELEGDNARLAVLKRTVELTHFAYPALNLPPKVMSAVMDQVLIKRASPLSEEEMQDPESSDEGKPVVSDEQLARWLGASSTPQSLEERRKLMMAVVLVTVELECLRRFFADAETLRKVEENLHYLFRHGFVRQACKISNVELTNLVSYMGILHENRLGQNVLHTTLRGEARRDYIRDCVYLYLCHTWQTGMGVWQQCLEEQNLKELCKLLQKNLKALWTGFDERTTAADLADLIFPERLRLTLRNGLPDFMSQSMLQNFRSFILERSGILPATCSALPSDFVPLTFRECPPPLWSHCYLLRLANYLAYHSDVIEDVSGEGLLECHCRCNLCTPHRSLACNPQLLSETQIIGTFELQGPGEGKGGLKLTPGLWTSAYLRKFVPEDYHPFEIRFYEDQSQPPKVELSACVITQGAILAQLQAIQKSRQEFLLKKGHGVYLDPQTGEELNPSFPQDAPRKQQEAESGAAAAGGFGGRLGEQSGRGGDGRLGQHSGRGGQPARQSGGGRRGGGGGRGRSSRRQTVVLGGGESKQHGYHLRSGSGSRRPGPQ

SEQ ID NO: 99 - protein, 227 aa, Unknown
  Synthetic Construct
MSKEIPTPYMWSYQPQMGLAAGAAQDYSTRMNWLSAGPAMISRVNDIRAHRNQILLEQSAITATPRHHLNPRNWPAALVYQEIPQPTTVLLPRDAQAEVQLTNSGVQLAGGAALCRHRPAQGIKRLVIRGRGTQLNDEVVSSSLGLRPDGVFQLAGSGRSSFTPRQAVLTLESSSSQPRSGGIGTLQFVEEFTPSVYFNPFSGSPGHYPDEFIPNFDAISESVDGYD

SEQ ID NO: 100 - protein, 106 aa, Unknown
  Synthetic Construct
MSHGGAADLARLRHLDHCRRFRCFARDLAEFAYFELPEEHPQGPAHGVRIIVEGGLDSHLLRIFSQRPILVEREQGQTRLTLYCICNHPGLHESLCCLLCTEYNKS

SEQ ID NO: 101 - protein, 177 aa, Unknown
  Synthetic Construct
MGKITLVSCGALVAVVLSIMGLGGAAVVKEEKADPCLHFNPDKCQLSFQADGNRCAVLIKCGWECENVRIEYNNKTRNNTLASVWQPGDPEWYTVSVPGADGSPRTVNNTFIFAHMCDTVMWMSKQYDMWPPTKENIVVFSIAYSLCTVLITAIVCLSIHMLIAIRPRNNAEKEKQP

SEQ ID NO: 102 - protein, 206 aa, Unknown
  Synthetic Construct
MASVKFLLLFASLIAVIHGMSNEKITIYTGTNHTLKGPEKATEVSWYCYFNESDVSTELCGNNNKKNESITLIKFQCGSDLTLINITRDYVGMYYGTTAGISDMEFYQVSVSEPTTPRMTTTTKTTPTTTTQLTTNGFLAMLRVAENSTSIQPTPPSEEIPRSMIGIIVAVVVCMLIIALCMVYYAFCYRKHRLNDKLEHLLSVEF

SEQ ID NO: 103 - protein, 205 aa, Unknown
  Synthetic Construct
MKILGLLVFSIITSALCNSDNEDVTVVVGSNYTLKGPAKGMLSWYCYFGSDTTETELCNLKNGKIQNSKINNYICNGTDLILLNVTKAYSGSYTCPGDDADNMIFYKVEVVDPTTPPPPTTTTTHTTHTEQTTAEEVAKLALQVQGSSFVGITPTPDQRCPGLLVSGIVGVLSGLAVIIICMFIFACCYRRLYRQKSDPLLNLYV

SEQ ID NO: 104 - protein, 293 aa, Unknown
  Synthetic Construct
MKAVSTLVFCSLIGTVFSVSFLKQINVTEGENVTLVGVEGAQNTTWTKYHLDGWKDICNWSVITYTCEGVNLTIVNASQNQKGWIKGQSVSVTSEGYYTQHTLIYDIIVIPLPTPSPPSTTTQTTHTTHTTTYSTSNQPTTTTAAEVASSSGVQVAFLLLPPSSSPTASTNEQTTEFLSTVESHTAATSSAFSSTANLSSLSSTPISPATTTPTPALLPTPLKQTEDGGMQWQITLLIVIGLVILAVLLYYIFCRRIPNAHRKPVYKPIVVGQPEPLQVEGGLRNLLFSFTVW

SEQ ID NO: 105 - protein, 144 aa, Unknown; identical to SEQ ID NO: 48
  Synthetic Construct

SEQ ID NO: 106 - protein, 425 aa, Unknown
  Synthetic Construct
MSKKRVRVDDDFDPVYPYDADNAPTVPFINPPFVSSDGFQEKPLGVLSLRLADPVTTKNGEITLKLGEGVDLDSSGKLISNTATKAAAPLSFSNNTISLNMDHPFYTKDGKLALQVSPPLNILRTSILNTLALGFGSGLGLRGSALAVQLVSPLTFDTDGNIKLTLDRGLHVTTGDAIESNISWAKGLKFEDGAIATNIGNGLEFGSSSTETGVDDAYPIQVKLGSGLSFDSTGAIMAGNKEDDKLTLWTTPDPSPNCQILAENDAKLTLCLTKCGSQILATVSVLVVGSGNLNPITGTVSSAQVFLRFDANGVLLTEHSTLKKYWGYRQGDSIDGTPYANAVGFMPNLKAYPKSQSSTTKNNIVGQVYMNGDVSKPMLLTITLNGTNDSNSTYSMSFSYTWTNGSYVGATFGANSYTFSYIAQE

SEQ ID NO: 107 - DNA, 29970 bp, Unknown
  Simian adenovirus A1309
  CDS (4)..(1518): E1b\55K
  CDS (23660)..(24229): 22K
  CDS (25527)..(26150): E3\CR1-alpha
  CDS (29560)..(29964): E3\14.7K
caaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagtcaccccaggaacaccaacgccgccagcagccgcagcaggagcagcagcaagaggaggaggaggaggaccgagaagagaacccgagagccggtctggaccctccggtggcggaggaggaggagtagctgacttgtttcccgagctgcgccgggtgctgactaggtcttccagtggacgggagagggggattaagcgggagaggcatgaggagactagccatagaactgaactgactgtcagtctgatgagccgcaggcgtccagaatcggtgtggtggcatgaggttcagtcgcaggggatagatgaggtctcagtgatgcatgagaaatattccctagaacaagtcaagacttgttggttggagcctgaggatgattgggaggtagccatcaggaattatgccaagctagcgctgaagccagacaagaagtacaagattaccaagttgattaatatcagaaattcctgctacatttcagggaatggggccgaggtggagatcagtacccaggagagggtggccttcagatgctgcatgatgaatatgtacccgggggtggtgggcatggagggagtcacctttatgaacgcgaggttcaggggtgatgggtataatggggtggtctttatggccaacaccaagctgacagtgcacggatgctccttctttggcttcaataacatgtgcatcgaggcctggggcagtgtttcagtgaggggatgcagcttttcagccaactggatgggggttgtgggcagaaccaagagcatggtgtcagtgaagaaatgtctgttcgagaggtgccacctgggggtgatgagcgagggcgaagccaaagtcaaacactgcgcctctaccgagacgggctgctttgtgctgatcaagggcaatgccaaagtcaagcataacatgatctgtggggcctctgatgagcgcggctaccagatgctgacctgcgccggtgggaacagccatatgctggccactgtgcatgtgtcctcgcacccccgcaagacatggcccgagttcgagcacaacgtcatgacccgctgcaatgtgcacctgggctcccgccgaggcatgttcatgccctaccagtgcaacatgcaatttgtgaaggtgctgctggagcccgatgccatgtccagagtgagcctggcgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggaggtggagggcctgcatgaggggcagaatgactaaaatctgtgtttttctgcgcagcagcatgagcggaagcgcctcctttgagggaggggtattcagcccttatctgacggggcgtctcccctcctgggctggagtgcgtcagaatgtgatgggatccacggtggacggccggcccgtgcagcccgcgaactcttcaaccctgacctacgcgaccctgagctcctcgtccgtggacgcagctgccgccgcagctgctgcttcagccgccagcgccgtgcgcggaatggccctgggcgccggctactacagctctctggtggccaactcgagttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctattgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtggccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagcccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccaggggcgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtacagcttgggggcgaggaagacggactcgggggcgtaggcgtccgcgccgcagctggcgcagacggtctcgcactccacgagccaggtgaggtcggggcggtcggggtcaaaaacgaggtttcctccgtgctttttgatgcgtttcttacctctggtctccatgagctcgtgtccccgctgggtgacaaagaggctgtccgtgtccccgtagaccgactttatgggtcggtcttcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagatcgtccagcgccgcttgccagtcgcgcacggccagcgcgcgctcgtaggggctgaggggcgtgccccagggcatggggtgtgtgagcgcggaggcgtacatgccgcagatgtcgtagacgtagaggggctcttcgaggacgccgatgtaggtggggtagcagcgccccccgcggatgctggcgcgcacgtagtcgtacagctcgtgcgagggcgcgaggagccccgtgccgagattggagcgctgcggcttttcggcgcggtagacgatctggcggaagatggcgtgggagttggaggagatggtgggcctctggaagatgttgaagtgggcgtggggcaggccgaccgagtccctgatgaagtgggcgtaggagtcttgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaagcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagagcccagtcggcgaggtgggggttggcactgaggaaggaagaccagagatccacggccagggcggtctgcaagcggtcccggtactgacggaactgccggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctcgtgctgtactacgtcctggccatcggcgtggccatcgtctgcctcgatggtggtcatgctgacgaggccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgttttttcttgggcgctggcggcggcggctccatgcttagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtagaagtccacggcgaagttgaaaaactgggagttgcgcgccgagacggtcaactcctcctccagaagacggatgagctcggcgatggtggcgcgcacctcgcgctcgaaggccccggggggctcctcctcttccatctcctcctcctcttcctcctccactaacatctcttctacttcctcctcaggaggcggcggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattgacccgtagggactccgcgcaaggacctgagcgtctcgagatccacgggatccgaaaaccgctgaacgaaggcttcgagccagtcgcagtcgcaaggtaggctgagcccggtttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctgtggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgttcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgttttggcaattttcgtcaggccggaaatgaaactagtaagcgcggaaagcggccgcccgcgatggctcgctgccgtagtctggagaaagaatcgccagggttgcgttgcggtgtgccccggttcgagactcagcgctcggcgccggccggattccgcggctaacgtgggcgtggctgccccgtcgtttccaagaccccttagccagccgacttctccagttacggagcgagcccctctttttcttgtgtttttgccagatgcatcccgtactgcggcagatgcgcccccaccctccaccacaaccgcccctaccgcagcagcagcaacagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggatcgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcacgctgatcgcgcgcgaggaggtgaccctgggcctgatgcacctgtgggacctgctggaggccattgtgcagaatcccacgagcaagccgctgacggcgcagctgtttctggtggtgcagcacagtcgggacaacgagacgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagcctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggcgtgccctacgtggaggaggtggacgatgaggaggaggagggcgagtacctggaagactgatggcgcgaccgtatttttgctagatgcagcaacagccaccgccgccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggcgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcgggcaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgccgcgctcgacatgaccgcgcgcaacatggagcccagcatgtacgcccgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgccccaccaccaccgtgtggaagaaagagggcggggaccggcggccgtcctcggcgctgtccggtcgcgcgggtgctgccgcggcggtgcccgaggccgccagccccttcccgagcctgcccttttcgctgaacagcgtgcgcagcagcgagctgggtcggctgacgcggccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcagcgcaggcgccacccgtagacgccagcggcacgacaggcagcggggtctggtgtgggacgatgaggattccgccgacgacagcagcgtgttggacttgggtgggagtggtggtggtaacccgttcgctcacctgcgcccccgcatcgggcgcctgatgtaagaatctgaaaaaataaaaaacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaacggggtcacggtaggggatgattatgatggtagtcaggacgagctgacctacgagtgggtggagtttgagctgcccgagggcaacttctcggtgaccatgaccatcgatctgatgaacaacgccatcatcgacaactacttggcggtggggcggcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctacgagaaaagcaaggaggatagcgccgcagcggcgaccgcagccgtggctaccgccgcgactgtggcagatgccactgtcaccaggggcgatacattcgccacccaggcggaggaagcagccgccctagcggcgaccgatgatagtgaaagtaagatagttatcaagccggtggagaaggacagcaaggacaggagctacaacgttctatcggatggaaagaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaattcaaggaagagatgctccaggtcatcgcgcctgagatctacggcccggctgcggtgaaggaggaaagaaagccccgcaaactgaagcgggtcaaaaaggacaaaaaggaggaggaagatgacggactggtggagtttgtgcgcgagttcgccccccggcggcgcgtgcagtggcgcgggcggaaagtgaaaccggtgctgcgacccggcaccacggtggtcttcacgcccggcgagcgttccggctccgcctccaagcgctcctacgacgaggtgtacggggacgaggacatcctcgagcaggcggccgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggtgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcgccggcctccaccaccaccactcgccgaagacgcaagtacggcgcggccagcctgctgatgcccaactacgcgctgcatccttccatcatccccacgccgggctaccgcggcacgcgcttctaccgcggctacaccagcagcagccgccgcaagaccaccacccgccgccgccgtcgtcgcacccgccgcagcagcaccgcgacttccgccgccgccctggtgcggagagtgtaccgcagcgggcgcaagcctctgaccctgccgcgcgcgcgctaccacccgagcatcgccatttaactctgccgtcgcctccttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggtctgcccaccacgcgccccgtggcgcctctggccaccggggtgctgaaacccagcagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtgtatatgtatgtccgccgaccagaaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccccagcttcaaaccctactccggcaccgcctacaacagcctggctcccaaggctgctcctaatccgagccagtgggaagaaaccactgcaggaacaaatgggaatgccgatgccactactaccactcatagctttggactggctgctatgaagggggacaacattacatctgatggtttgcagataggaacggatgctagttctggagaagaaaaacccatctatgcagataaactgtaccagccagaaccccaaataggggaagagtcatggaccgatactgatggaaccaatgaaaaatttggaggaagagtccttaaaaaggacacaagcatgaagccttgctatgggtcatttgccaaacccactaataacaaaggtggacaggcaaaacaaaaggcaactgaaggaactgatatagagtatgatgttgacatgaaatttttcgatggtagggatgcggctgctaactttactccagaagtagtgttgtatgctgaaaatgttgatctggaaactccagatacccacattgtatacaaaccaggaacctctgatgtaagttcccatgttaatttgggacaacagtctatgcccaacagacccaactacattggcttcagagacaactttatcggtctcatgtactacaacagcactggcaatatgggtgtactggctggtcaggcctcccagctgaatgctgtggtggacttgcaggacagaaacaccgaactgtcctaccagctcttgcttgactctctgggtgacagaaccaggtatttcagtatgtggaatcaggcggtggacagctatgaccccgatgtgcgcattattgaaaaccatggtatagaagacgaacttcccaactattgcttccctctggatgctgtgggtattaccagaacctatcaaggcatcaaattgcaaaatggtcaaactaccacctgggaaaaggatgacagcgttagcactgccaatgaaataggaattggcaacaatctggccatggagatcaacatccaggccaacctgtggcggaacttcctctacgcgaacgtggccctgtacctgcccgactcctacaagtacacgccggccaacatcacgctgccgaccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccattccggccaacgccaccaacgtgcccatctccatcccctcgcgcaactgggccgccttccgcggctggtcattcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagagggatacaacgtggctcagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagccgctcttgcttcttgcaagatgacggcctgtggctccggcgagcaggagctcagggccatcctccgcgacctgggctgcgggccctacttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaaaaaaccggtgtgtgtatgtgaatgctttattcataataaacagcacatgtttatgccaccttttctgaggctctgactttatttagaaatcgaaggggttctgccggctctcggcatgccccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcacagttgggacccgcgttctgcgcgcgagagttgcggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagcccgcgtcgtgcacgcagcagcgcgcgtcgttgttggccagctgcaccacgctgcgcccccagcggttctgggtaatcttggcccggtcggggttctccttcagcgcgcgctgcccgttctcgctcgccacatccatctcgatcgtgtgctccttctggatcatcacggtcccgtgcaggcaccgcagcttgccctcggcctcggtgcagccgtgcagccacagcgcgcagccggtgcactcccagttcttgtgggcgatctgggagtgcgagtgcacgaagccctgcaggaagcggcccatcatcgtagtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgtcatcttagtcgccgccgccgaggtcagggggtcgttctcgtccagggtttcaaacactcgcttgccgtccttctcggtgatgcgcacggggggaaagctgaagcccacggccgccagctcctcctcggcctgcctttcgtcctcgctgtcctggctgatgtcttgtaaaggcacatgcttggtcttgcggggtttctttttgggcggcagaggcggcggcggcggagacgtgctgggcgagcgcgagttctcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaagcatggagactcagccatcgtcgccaacatcgccatctgcccccgccgccgacgagaaccagcagcagaatgaaagcttaaccgccccgccgcccagccccacctccgacgcggccccagacatgcaagagatggaggaatccatcgagattgacctgggctacgtgacgcccgcggagcacgaggaggagctggcagcgcgcttttcagccccggaagagaaccaccaagagcagccagagcaggaagcagagagcgagcagcagcaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacctctttttcaagaatcaaaggatccccgtctcctgccgcgccaaccgcacccgcgccgacgccctactcaacctgggccccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtactcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgtctggaggagcagaacctgaaagagctctgcaagctcctgcagaagaacctcaaggccctgtggaccgggttcgacgagcgcaccaccgccgcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacctgctgcgtctggctaactacctggcctaccactcggacgtgatcgaggacgtcagcggcgagggtctgctcgagtgccactgccgctgcaacctctgcacgccgcaccgctccctggcctgcaacccccagctgctgagcgagacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggtcgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccggaggatttggaggaagactgggagagcagtcaggcagaggaggagatggaagactgggacagcactcaggcagaggaggacagcctgcaagacagtctggaggaggaagacgaggtggaggaggaggcagaggaagaagcagccgccgccagaccgtcgtcctcggcggaggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagaaaaccagcggcagcagcagctagaaaatccacggcggcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcggctgacctagctcggcttcgacacctggaccactgccgccgcttccgctgcttcgctcgggatctcgccgagtttgcctactttgagctgcccgaggagcaccctcagggtccggcccacggagtgcggatcatcgtcgaagggggcctcgactcccacctgcttcggatcttcagccagcgaccgatcctggtcgagcgcgagcaaggacagacccgtctgaccctgtattgcatctgcaaccaccccggcctgcatgaaagtctttgttgtctgctgtgtactgagtataataaaagctgagatcagcgactactctggactcgattgtggtgttcctgctatcaaccggtccctgttcttcaccggaaacgagaccgagctccagctccagtgtaagccccacaagaagtacctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcggcgctccccgctactaacaaccaaactacccaccaacgccaccgtcgcgacctttcctctgaatctaataccacccacaccggaggtgagctccgaggtcgaccaacctctgggatttactacggcccctgggaggtggtggggttaatagcgctaggcctagttgcgggtgggcttttggttctctgctacctatacctcccttgctgttcgtacttagtggtgctgtgttgctggtttaagaaatggggaagatcaccctagtgagctgcggtgcgctggtggcggtggtgctttcgattatgggactgggcggcgcggctgtagtgaaggaggagaaggccgatccctgcttgcatttcaatcccgacaaatgccagctgagttttcaggccgatggcaatcggtgcgcggtgctgatcaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaataatactttcatttttgcacacatgtgcgacacggtcatgtggatgagcaagcagtacgatatgtggccccccacgaaggagaacatcgtggtcttctccatcgcttacagcctgtgcacggtgctaatcaccgctatcgtgtgcctgagcattcacatgctcatcgctattcgccccagaaataatgccgagaaagaaaaacagccataacacgttttttcacacacctttttcagaccatggcctctgttaaatttttgcttttatttgccagtctcattgccgtcattcatggaatgagtaatgagaaaattactatttacactggcactaatcacacattgaaaggtccagaaaaagccacagaagtttcatggtattgttattttaatgaatcagatgtatctactgaactctgtggaaacaataacaaaaaaaatgagagcattactctcatcaagtttcaatgtggatctgacttaaccctaattaacatcactagagactatgtaggtatgtattatggaactacagcaggcatttcggacatggaattttatcaagtttctgtgtctgaacccaccacgcctagaatgaccacaaccacaaaaactacacctactaccaccacacagctcactaccaatggctttcttgccatgcttcgagtggctgaaaatagcaccagcattcaacccaccccacccagtgaggaaattcccagatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctaggccttttagttttttctatcattacctctgctctatgcaattctgacaatgaggacgttactgtcgttgtcggatcaaattatacactgaaaggtccagcgaagggtatgctttcgtggtattgctattttggatctgacactacagaaactgaattatgcaatcttaagaatggcaaaattcaaaattctaaaattaacaattatatatgcaatggtactgatctgatactcctcaatgtcacgaaagcatattctggcagctacacctgccctggagatgatgctgacaatatgattttttacaaagtggaagtggttgatcccactactccacctccacccaccaccacaaccactcataccacacacacagaacaaaccacagcagaggaggtagcaaagttagccttgcaggtccaaggcagttcatttgttggcattacccctacacccgatcagcggtgtccggggctgctcgtcagcggcattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcactctagttttttgttctttgattggcactgtttttagtgttagctttttgaaacaaattaatgttactgagggggaaaatgtgacactggtaggcgtagaaggtgctcaaaataccacctggacaaaataccacctcgatgggtggaaagatatttgcaattggagtgtcattacttacacatgtgagggagttaatttgaccatagtcaatgccagccaaaatcagaagggttggattaaagggcaatctgttagtgttaccagtgaggggtactatacccagcatactcttatctatgacattatagtcataccgctgcctacgcctagcccacctagcactaccacacagacaacccacactacacacacaaccacatacagtacatcaaatcagcctaccaccactacagcagcagaggttgccagctcgtctggagtccaagtggcatttttgttgttgcccccatctagcagtcccactgctagtaccaatgagcagactactgaatttttgtccactgtcgagagccacaccgcagctacctccagtgccttctctagcaccgccaatctctcctcgctttcctctacaccaatcagtcccgctactactactcctacccccgctcttctccccactcccctgaagcaaactgaggacggcggcatgcaatggcagatcaccctgctcattgtgatcgggttggtcatcctggccgtgttgctctactacatcttctgccgccgcattcccaacgcgcaccgcaagccggtctacaagcccatcgttgtcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcatcacctgcatctgctgctgtagcatagtctgcctgcttatcaccttcttccagttcattgactggatctttgtgcgcatcgcctacctgcgccaccacccccagtaccgcgaccagcgagtggcgcggctgctcaggatcctctgataagcatgcgggctctgctacttctcgcgcttctgctgttagtgctcccccgtcccgtcgacccccggacccccacccagtcccccgaggaggtccgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcaacctcaggcacacgcactaccaccaccaccacagcctaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatca

SEQ ID NO: 108 - protein, 505 aa, Unknown
  Synthetic Construct
MESRNPFQQGLPSGLLSSSFVENMEVPAPECNLRLLASTAGRHAEDPESPVTPGTPTPPAAAAGAAARGGGGGPRREPESRSGPSGGGGGGVADLFPELRRVLTRSSSGRERGIKRERHEETSHRTELTVSLMSRRRPESVWWHEVQSQGIDEVSVMHEKYSLEQVKTCWLEPEDDWEVAIRNYAKLALKPDKKYKITKLINIRNSCYISGNGAEVEISTQERVAFRCCMMNMYPGVVGMEGVTFMNARFRGDGYNGVVFMANTKLTVHGCSFFGFNNMCIEAWGSVSVRGCSFSANWMGVVGRTKSMVSVKKCLFERCHLGVMSEGEAKVKHCASTETGCFVLIKGNAKVKHNMICGASDERGYQMLTCAGGNSHMLATVHVSSHPRKTWPEFEHNVMTRCNVHLGSRRGMFMPYQCNMQFVKVLLEPDAMSRVSLAGVFDMNVELWKILRYDESKTRCRACECGGKHARLQPVCVEVTEDLRPDHLVLSCNGTEFGSSGEESD

SEQ ID NO: 109 - protein, 190 aa, Unknown
  Synthetic Construct
MPRGSSKKLKVELPPPEDLEEDWESSQAEEEMEDWDSTQAEEDSLQDSLEEEDEVEEEAEEEAAAARPSSSAEEKASSTDTISAPGRGRGGRAHSRWDETGRFPNPTTQTGKKERQGYKSWRGHKNAIVSCLQACGGNISFTRRYLLFHRGVNFPRNILHYYRHLHSPYYCFQEEAETQQQQQKTSGSSS

SEQ ID NO: 110 - protein, 208 aa, Unknown
  Synthetic Construct
MKVFVVCCVLSIIKAEISDYSGLDCGVPAINRSLFFTGNETELQLQCKPHKKYLTWLFQGSPIAVVNHCDNDGVLLSGPANLTFSTRRSKLQLFQPFLPGTYQCVSGPCHHTFHLIPNTTAALPATNNQTTHQRHRRDLSSESNTTHTGGELRGRPTSGIYYGPWEVVGLIALGLVAGGLLVLCYLYLPCCSYLVVLCCWFKKWGRSP

SEQ ID NO: 111 - protein, 135 aa, Unknown; identical to SEQ ID NO: 54
  Synthetic Construct

SEQ ID NO: 112 - DNA, 870 bp, Unknown
  Simian adenovirus A1309
  CDS (6)..(573): E1a
  CDS (658)..(863): E1a
gaaagatgaggcacctgagagacctgcccggtaatgttttcctggctactgggaacgagattctggaactggtggtggacgccatgatgggtgacgaccctccggagccccctaccccatttgaagcgccttcgctgtacgatttgtatgatctggaggtggatgtgcccgagaacgaccccaacgaggaggcggtgaatgatttgtttagcgatgccgcgctgctggctgccgagcaggctaatacggactctggctcagacagcgattcctctctccataccccgagacccggcagaggtgagaaaaagatccccgagcttaaaggggaagagctcgacctgcgctgctatgaggaatgcttgcctccgagcgatgatgaggaggacgaggaggcgattcgagctgcagcgaaccagggagtgaaaacagcgagcgagggctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagctggggaggcagagggtgactgggtgctgactggtttatttatgtatatgttttttatgtgtaggtcccgtctctgacgtagatgagacccccactacagagtgcatttcatcacccccagaaattggcgaggaaccgcccgaagatattattcatagaccagttgcagtgagagtcaccgggcgtagagcagctgtggagagtttggatgacttgctacagggtggggatgaacctttggacttgtgtacccggaaacgccccaggcactaagtgc

SEQ ID NO: 113 - protein, 258 aa, Unknown
  Synthetic Construct
MRHLRDLPGNVFLATGNEILELVVDAMMGDDPPEPPTPFEAPSLYDLYDLEVDVPENDPNEEAVNDLFSDAALLAAEQANTDSGSDSDSSLHTPRPGRGEKKIPELKGEELDLRCYEECLPPSDDEEDEEAIRAAANQGVKTASEGFSLDCPTLPGHGCKSCEFHRMNTGDKNVMCALCYMRAYNHCVYSPVSDVDETPTTECISSPPEIGEEPPEDIIHRPVAVRVTGRRAAVESLDDLLQGGDEPLDLCTRKRPRH

SEQ ID NO: 114 - DNA, 36667 bp, Unknown
  Simian adenovirus A1316
  repeat_region (1)..(128): ITR
  CDS (1905)..(3416): E1b\55K
  CDS (3504)..(3929): pIX
  misc_feature (3994)..(5615): IVa2    complement (3994..5324,5603..5615)
  misc_feature (5097)..(13849): pol    complement (5097..8678,13841..13849)
  misc_feature (8480)..(13849): pTP    complement (8480..10408,13841..13849)
  CDS (10841)..(12019): 52K
  CDS (12046)..(13812): pIIIa
  CDS (13897)..(15486): penton
  CDS (15490)..(16068): pVII
  CDS (16113)..(17144): V
  CDS (17168)..(17398): pX
  CDS (17433)..(18206): pVI
  CDS (18312)..(21125): hexon
  CDS (21152)..(21784): protease
  misc_feature (21864)..(23399): DBP    complement (21864..23399)
  CDS (23428)..(25830): 100K
  CDS (26452)..(27132): pVIII
  CDS (27410)..(28042): E3\CR1-alpha
  CDS (28532)..(29323): E3\CR1-beta
  CDS (29339)..(29962): E3\CR1-gamma
  CDS (29985)..(30881): E3\CR1-delta
  CDS (30893)..(31165): E3\RID-alpha
  CDS (31174)..(31602): E3\RID-beta
  CDS (32253)..(33578): fiber
  misc_feature (33671)..(34818): E4\orf6/7    complement (33671..33922,34645..34818)
  misc_feature (33922)..(34818): E4\orf6    complement (33922..34818)
  misc_feature (34911)..(35252): E4\orf4    complement (34911..35252)
  misc_feature (35101)..(35451): E4\orf3    complement (35101..35451)
  misc_feature (35451)..(35837): E4\orf2    complement (35451..35837)
  misc_feature (35890)..(36261): E4\orf1    complement (35890..36261)
  repeat_region (36540)..(36667): ITR    complement (36540..36667)
catcatcaataatatacctcaaactttttgtgcgcgttaatatgcaaatgaggcgtttgaatttggggatgcggggttgtgattggctgcggggaaggcgaccgttaggggcggggcgggtgacgtttcgatgacgtggccgtgaggcggagccggtttgcaagttctcgtgggaaaagtgacgtcaaacgaggtgtggtttgaacacggaaatactcaattttcccagcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtaggcgtcagctgatcgccagggtatttaaacctgcgctctctagtcaagaggccactcttgagtgccagcgagtagagctttctcctccgcgccgcgagtcagatctacactttgaaagatgaggcacctgagagacctgcccggtaatgttttcctggctactgggaacgagattctggaattggtggtggacgccatgatgggtgacgaccctcccgagccccctactccatttgaggcgccttcgctgtacgatttgtatgatctggaggtggatgtgcccgagaacgaccccaacgaggaggcggtgaatgatttgtttagcgatgccgcgctgctggctgccgagcaggctaatacggactctggctcagacagcgattcctctctgcataccccgagacccggcagaggtgagaaaaagatccccgagcttaaaggggaagagctcgacctgcgctgctatgaggaatgcttgcctccgagcgatgatgaggaggacgaggaggcgattcgagctgcagcgaaccagggagtgaaagcagcgagcgagggctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagttggggaggcagggggtgactggatgctgactggtttatttatgtatgtattctttatgtgtaggtcccgtctctgacgcagatgagacccccacttcagagtgcatttcatcacccccagaaattggcgaggaaccgcccgaagatattattcatagaccagttgcagtgagagtcaccgggcggagagcagctgtggagagtttggatgacttgctacagggtggggatgaacctttggacttgtgtacccggaaacgccccaggcactaagtgccacacatgtgtgtttacttaaggtgatgtcagtatttatagggtgtggagtgcaataaaatccgtgttgactttaagtgcgtggtttatgactcaggggtggggactgtgggtatataagcaggtgcagacctgtgtggtcagttcagagcaggactcatggagatctggacggtcttggaagactttcaccagactagacagctgctagagaactcatcggagggagtctcttacctgtggagattctgcttcggtggggctctagctaagctagtccatagggccaaacaggattataaggatcaatttgaggatattttgagagagtgtcctggtatttttgactctctcaacttgggccatcagtctcactttaaccagagtattctgagagcccttgacttttctactcctggcagaactaccgccgcggtagccttttttgcctttatccttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagttaccccaggaacaccaacgccgccagcagccgcagcaggagcagcagcaagaggaggaggaggaccgagaagagaacccgagagccggtctggaccctccggtggtggaggaggaggagtagctgacttgtttcccgagctgcgccgggtgctgactaggtcttccagtggacgggagagggggattaagcgggagaggcatgaggagactagtcacagaactgaactgactgtcagtctgatgagccgcaggcgcccagaatcggtgtggtggcatgaggtgcagtcaactggcacagatgaggtgtcagtgatgcatgagaggttttctctagaacaagtcaagacttgttggttggagcctgaggatgattgggaggtagccatcaggaattatgccaagctggctctgaggccagacaagaagtacaagattactaagctgataaatatcagaaatgcctgctacatctcagggaatggggctgaagtggagatctgtcttcaggaaagggtggctttcagatgctgcatgatgaatatgtacccgggagtggtgggcatggatggggtcacctttatgaacatgaggttcaggggagatgggtataatggcacggtctttatggccaataccaagctgacagtccatggctgctccttctttgggtttaataacacctgtatcgaggcctggggtcaggtcggtgtgaggggctgcagtttttcagccaactggatggggatcgtgggcaggaccaagagtgtgctgtctgtgaagaaatgcttgttcgagaggtgccacctgggggtgatgagcgagggcgaagccagaatccgccactgcgcctctaccgagacgggctgctttgtgctgtgcaagggcaatgctaagatcaagcataatatgatctgtggagcctcggacgagcgcggctaccagatgctgacctgcgccggtgggaacagccatatgctagccaccgtgcatgtggcctcccatgctcgcaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaagtgtggaagattctgagatatgatgaatccaagaccaggtgccgagcctgcgagtgcggagggaagcatgccaggttccagcccgtgtgtgtggatgtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagcatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctactacggcactctggtggccaactcgagttccaccaataatcccgccagcctgaacgaggagaagctgctgctgctgatggcacagctcgaggccttgacccagcgcctgggcgagctgacccagcaggtggctcagctgcaggagcagacgcgggctgcggttgccacggtgaaatccaaataaaaaatgattcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgttgcacaatatctttgaggaggagactgatggccacgggcagccctttggtgtaggtgtttacaaatctgttaagctgggagggatgcatgcggggggagatgaggtgcatcttggcctggatcttgagattggcgatgttgccgcccagatcccgcctggggttcatgttgtgcaggaccaccagcacggtgtatccggtgcacttggggaatttatcatgcaacttggaagggaaggcgtgaaagaatttggcgacgcccttgtgcccgcccaggttttccatgcactcatccatgatgatggcgatgggcccgtgggcggcggcctgggcaaagacgtttcgggggtcggacacatcatagttgtggtcctgggtgagatcatcataggccattttaatgaatttggggcggagggtgcccgattgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttgcggagcagctgtgacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcttcgagcggtgtgccgcggtcctcctcgtagaggaaccccgcccactccgagacgaaagcccgggtccaggccaagacaaaggaggccacgtgggacgggtagcggtcgttgtccaccagcgggtccaccttctccagggtatgcaaacacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggccgcgatgttgagctgcacgtactcgcgcgccacgcacttccattcggggaagacggtggtcagctcgtcgggcacgattctgacctgccagccccgattatgcagggtgatgaggtccacgctggtggccacctcgccgcgcaggggctcgttggtccagcagaggcgcccgcccttgcgcgagcagaaggggggcagggggtccagcatgacctcgtcgggggggtcggcatcgatggtgaagatgccgggcaggagatcggggtcgaagtagctgatggaagtgcccagatcgtccagggaagcttgccattcgcgcacagccagcgcgcgctcgtagggactgaggggcgtgccccagggcatggggtgggtgagcgcggaggcgtacatgccgcagatgtcgtagacgtagaggggctcctcgaggatgccgatgtaggtggggtagcagcgccccccgcggatactggcgcgcacgtagttatacagctcgtgcgagggcgcgaggagaccggggcccaggttggtgcgactgggcttttcggcgcggtagacgatctggcggaagatggcatgcgagttggaggagatggtgggcctttggaagatattgaagtgggcgtgggggaggccgaccgagtcgcggatgaagtgggcgtaggagtcttgcagcttggcgacgagctcggcggtgacgaggacgtccagagcgcagtagtcgagggtctcctggatgatgtcatacttgagctggcccttttgtttccacagctcgcggttgagaaggaactcttcgcggtccttccagtactcttcgagggggaacccgtcctgatctgcacggtaagagcctagcatgtagaactggttgacggctttgtaggcgcagcagcccttctccacggggagggcgtaggcctgggcggccttgcgcagggaggtgtgcgtgagggcgaaagtgtccctgaccatgactttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttgatgttgtggcccacgatgtaaagttccacgaaccgtgggcggcccttgacgtggggcagcttcttgagttcctcgtaggtgagctcgtcggggtcgctgaggccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcggtcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgaaccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccacgcgggaggcaggtccagacctcggcgcgagcgggtcggagagcgaggacgagagcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccatgcccctggggtgtgaccaccgtcccccgtttcttcttgggcggctggggcgacgggggcggtgcttcggcttccatggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcttggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcgacggagcggcatctcgctgacgtcgcccagcgcctccaaacgttccatggcctcgtaaaagtccacggcgaagttgaaaaactgggagttgcgcgccgagacggtcaactcctcctccagaagacggataagctcggcgatggtggcgcgcacctcgcgctcgaaggcccccgggagttcctcctcttcctcttcttcctcctcctccactaacatctcttctacttcctcctcaggcggcagtggtggcgggggagggggcctgcgtcgccggcggcgcacgggcagacggtcgatgaaacgctcgatggtctcgccgcgccggcgtcgcatggtctcggtgacggcgcgcccgtcctcgcggggcctcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggccggaaatgagactagtaagcgcggaaagcgaccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgtttttttgtttttgccagatgcatcccgtactgcggcagatgcgcccccaccaccctccaccgcaacaacagccccctcctccacagccggcgcttctgcccccgccccagcagcagcaacttccagccacgaccgccgcggccgccgtgagcggggctggacagagttatgaccaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctaagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggccggtcccccctacgtagaagaggtggacgatgaggtggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcgcccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcgccgaggaggagcgcatcctgcgatacgtgcagcagagcgtgggcctgttcctgatgcaggagggggccactcccagcgccgcgctcgacatgaccgcgcgtaacatggagcccagcatgtacgccagcaaccgcccgttcatcaataagctgatggactacttgcatcgggcggccgccatgaactctgactatttcaccaacgccattctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgcccgtcctcggcgctgtccgggcgcgagggtgctgccgcggcggtgcccgaggccgccagtcctttcccgagcttgcccttctcgctgaacagtatccgcagcagcgagctgggcaggatcacgcgcccgcgcttgctgggcgaggaggagtacttgaatgactccttgctgagacccgagcgggagaagaacttccccaataacgggatagagagcctggtggacaagatgagccgctggaagacgtatgcgcaggagcacagggacgatccgtcgcagggggccgcgagccggggcagcgccgcccgtaaacgccggtggcacgacaggcagcggggactgatgtgggacgatgaggattccgccgacgacagcagcgtgttggacttgggtgggagtggtaacccgttcgctcacctgcgcccccgcatcgggcgcatgatgtaagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgccaaacgtgaacgagttcatgtacagcaacaagttcaaggcgcgggtgatggtctcccgcaagacccccaacggggtgacagtgacagatggtagtcaggatatcttggagtatgagtgggtggagtttgagctgcccgaaggcaacttctcggtgaccatgaccatcgacctgatgaacaacgccatcatcgacaattacttggcggtggggcggcagaacggggtcctggaaagcgacatcggcgtgaagttcgacactaggaacttcaggctgggctgggaccccgtgaccgagctggtcatgcccggggtgtacaccaacgaggccttccatcccgatattgtcttgctgcccggctgcggggtggacttcaccgagagccgcctcagcaacctgctgggcattcgcaagaggcagcctttccaggagggtttccagatcatgtacgaggatctggaggggggcaacatccccgcgctcctggatgtcgaggcctatgagaaaagcaaggaggagagcgctgccgcggcgaccacagccgtagccaccgcctctaccgaggtcaggggcgataattttgccagccctgcagcagtggcagcggccgaggcggctgaaaccgaaagtaagatagtcattcagccggtggagaaggatagcaaggacaggagctacaacgtgctgccggacaagataaacaccgcctaccgcagctggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgacaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaagcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgatgtggacgatatggtggagtttgtgcgcgagttcgcccccaggcggcgcgtgcagtggcgcgggcggaaggtgcgaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgctccgcgccgaaggaagaagcggtgtccatcccgctggaccacggcaaccccacgccgagcctcaagcccgtgaccctgcagcaggtgctgccgaccgcggcgccgcgaagggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagatccccacggagcccatggaaacgcagaccgagcccatgatcaagcccagcaccagcaccatggaggtgcagacggatccctggatgccagccgcccccaccagcgggcgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccacccgccgccaccgtcgccgcacaaccgctgcaactaccgccgccgccctggtgcggagagtgtaccgccgcggccgcgcgcctctgaccctgccgcgcgcgcgctaccacccgagcatcgccatttaaaactttcgcctgctttgcagatggccctcacatgccgcctccgcgtccccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcaacaaggcgtggaacagcaccacagggcaggcgctgagggaaaagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtgaaactgggtctgcccaccacgcggcccatcgcgcccctggccaccggggtgctgaaacccgagagtagtaagcccgcgaccctggacttgcctcctcccgcttcccgcccctccacagtggctaagcccctgccgccggtggccgtggcccgcgcgcgacccgggggctccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgctgtcgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacgccctggcccctaaagccgctcctaatcctagccagtgggaggaaaccactactggaacggatggaaatgctgctactacaactacacatagttttggcctggctgctatgaaaggggacaatattacatctgacggtttgcaaataggaacagatgctacttctggagaggaaaaacccatctatgcagataaactgtaccagccagaaccccaaataggggaagagtcatggactgatactgatggaaccaatgaaaaattcggaggaagagtccttaaaaaggacacaagcatgaaaccctgctacgggtcatttgccaaaccaaccaataacaaaggtggtcaagcaaaacaaaaggcaactgaaggaaccgctgtagaatatgatgtagacatgaacttttttgatggtagagatgcagctgctaactttactccagaagtagtgttgtatgctgaaaatgtggatttggaaactccagatacacatattgtatacaaaccaggaacctcagatgtgagttcccatgttaatttgggacagcaagccatgcccaacagacccaactacattggtttcagagacaactttattggtctcatgtattacaacagcactggcaatatgggggtgctggccggtcaggcttctcagctgaatgctgtggttgacttgcaagacagaaacactgaactgtcctaccagctgttgcttgactctttgggtgacagaactcggtatttcagtatgtggaatcaggcggtggacagctatgatcctgatgtgcgcatcattgaaaatcatggtatagaagatgagcttcccaactattgctttcctattgacgctgtgggtattactagaacttatcaaggtatcaaaacgcaaaatggtcaaactacaacttgggaaaaggacaccagtgttagtacggccaatgaaataggcattggcaacaatcttgccatggaaatcaacatccaagccaacctgtggaggaacttcctctacgccaacgtggccctgtacctgcccgattcttacaagtacacaccggccaacgtcaccctgcccaccaataccaacacctacgattacatgaacggccgggtggtggcgccctcgctggtggacgcctacatcaacatcggggcgcgctggtcgctggaccccatggataacgtgaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagctgctatggcctgtgggtcctcgcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgtcgcagcgccctggccaccgaggaccgctgcatcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaaaccgtgtgtgtatgttaaaatatcttttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcattggccatcccgaagggggtcatcttgcaggtctgccttcccatggtgggcacgcagccgggcttgtggttgcaatcgcagtgcagggggatcagcatcatctgggcctggtcggcgttcattcccgggtacatggccttcatgaaagcctccaattgcctaaaagcttgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggttccgtgcaggcaccgcagcttgccctcggcctcggtgcatccgtgcagccacagcgcgcacccggtgcactcccagttcttgtgggcgatctgggaatgcgcgtgcacgaacccctgcaggaagcggcccatcatggtcgtcagagtcttgttgctagtgaaggtcagcgggatgccgcggtgctcctcattgatgtacaggtggcagatgcggcggtacacctcgccctgctcgggcatcagctggaaattggctttcaggtcggtctccacgcggtagcggtccatcagcatagtcatgatttccatgcccttctcccaggccgagacgatgggcaggctcatagggttcttcaccatcatcttagcactagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacatcctgcaggaccacatgcttggtcttgcggggtttcttcttgggcggcagcggtggtggagatgcttgtggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccaccgccgacgagaagcagcagcagcagaatgaaagcttaaccgctccgccgcccagccccgccacctccgacgcggcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatgacggcgactacctccacctgagcggaggggtggacgcgctcatcaagcatctggcccgacaggccatcatcgtcaaggacgcgctgctcgaccgcaccgaggtgcccctcagcgtggaggagctcagccgcgcctacgagctcaacctcttctcgccgcgtgtgccccccaagcgccagcccaacggcacctgcgagcccaacccgcgcctcaacttctacccggttttcgcggtgcccgaggccctggccacctaccacatcttttttaagaaccaaaagatccccgtctcctgccgcgccaaccgcacccgcgccgacgcccttttcaacctgggccccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctacccctcagagtttggaagagcggcgcaagctcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgattgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttcagccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggtttcccccaggatgccccgaggaaacaagaagctgaaagtggagctgccgcccgtggaggatttggaggaagactgggagagcagcagtcaggcagaggagatggaggaagactgggacagcactcaggcagaggaggacagcctgcaagacagtctggaagacgaggaggtggcagaggaggaggtggaagaagcagccgccgccagaccgtcgtcctcggcggaggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaacttcccccgcaacatcttgcattactaccgtcacctccacagcccctactacttccaagaagaggcagcagcagaaaaagaccatcagcagaaaaccagctagaaaatccacagcggcaggtggactgaggatcgcggcgaacgagccggcgcagactcgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcgtatcttcagccagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccggtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccggcacctatcagtgcatctcgggaccctgccatcacaccttccacctgatcccgaataccacctcttccccagcgccgctccccactaacaaccaaactaaccaccaacgctaccgacgcgacctcgtttctgaatctaataccacccacaccggaggtgagctccgaggtcctgattcctctgggatttattacggcccctgggaggtggtggggttaatagctttaggcttagtggcgggtgggcttttggctctctgctacctatacctcccttgcttttcctacttagtggtgctttgttgctggtttaaaaaatggggaagatcaccctagtgtgcggtgtgctggtgacggtggtgctttcgattctgggagggggaagcgcggctgtagtgacggagaagaaggccgatccctgcttgactttcaaccccgataaatgccagctgagttttcagcccgaaggcaatcggtgcatagtgctgatcaagtgcggatgggaatgcaaggatgtgagaatccagcacaataacaagacgcggaacaatactctcgcgtccacatggcagcccggggaccccgagtggtacaccgtctctgtccctggtgctgacggctccctccgcacggtgaacaacactttcatttttgagcacatgtgcgaaaccgccatgttcatgagcaagcagtacggcatgtggcctccgcgtaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacattcacacaccttgttttttacagacaatgcgtctgttaatttttgttatcattacactcagcattaataatgcccatggctatgcaaatatacaaaaaaccctctatgtaggctctgactctacattagaaggtactcaatctcaagccagggtttcatggtatttttataaaggcaatgataaaccaattactctttgcaaaggtgatcaggggcgcataacaaagccacctatcacatttagctgcaccagaacaaacctcacgcttttatccattacaaaacaatatgctggcacttattacagcacaaattttcatagtgggcaagataaatattatactgttaaggtagaaaaccctactacccctagaacaactacaaagcccaccacaactaagaagcccactacacctaagaagcctaccacgcccaaaaccactaagacaacaactactaagaccactaccacagagccaaccacgaccagcaccacacttgctataactacacacacacacactgagctgacctcgcaggcaactactgaaaatggttttgccctactgcagaagggggagaacagtagcagcagtcttatgcctactacccccagtgaggaaatacccaagtccatggttggcattatcgctgctgtagtggtgtgtatggtgattatcatcttgtgcatgatgtactatgcctgctactacagaaaacacaggctgaacaacaagctggaccccctactgaatgttgatttttaattttttagaaccatgaagatcctaagcctttttgttttttctataattattacctctgctatttgtgaatcagtggataaggacgttactgtcaccactggctctaattatacactaaaagggccttcctcaggtatgctttcgtggtattgttattttggaaatgatgataaacagacagagctatgtaattttcagaacggcaaaaccaaaaattctaaaatagataactatcaatgccagggtactgatttagtactgatgaatatcacgaaagcatatgctggcagttattcatgtcctggacaaaacaccgaggaaatgattttttacaaattaattgtagttgaccctactactccagcaccaaccaccacaactaccaaggcacataccacagacacacaggaaaccactccagaggcagaagcagagatagcaaagcagattcatgaagattcctttgttgccaatacccccacacaccccggaccgcaatgtccagggccattagtcagcggcattgtcggtgtgctttgcgggttagcagttataatcatctgcatgttcatttttgcttgctgctacagaaggcttcaccgacaaaaatcagacccactgctgaacctctatgtttaatttttgattttccagagccatgaaggcacttagcactttagtatttttgtccttgattggcattgtttttactagtcaaattaccagggttagatttatcaaatatgttaatgttactgaaggagataatatcacactagcaggtgtagaaggtgcccaaaacaccacctggacaaaataccatctcgggtggaaagatatttgcacctggaatgtcacttatttttgcataggagttaatcttaccattgtcaatgctaatcaatctcagaatggattaattaaaggccaaagtgttagtgtgaccagtgatgggtattatacccagcatagtttcaactacaacatcactgtcataccactgcccacacctagtccacctagcactactcaaaccacacaaacaactcacactacacagaactccacaactaccatgcagaccactcagacaactacatcccctcagcccaccaccactacagcagaggcgagtagctcacctaaaattgaagtggcatttttgttactgccaccatctagcagtcccactgctagtaccaatgagcagactactgaatttttgtccactactcagagcagcaccacagctacctcgagtgccttctctagcaccgccaatctcacctcgctttcctctacgccaatcagtaacgctactacctcccccgctcctcttcccactcctctgaagcaatccgagtctagcacgcagctgcagatcaccctgctcattgtgatcggggtggtcatcctggcagtgctgctctactttatcttctgccgccgcatccccaacgcgaaaccggcctacaagcccattgttatcgggacgccggagccgcttcaggtggagggaggtctaaggaatcttctcttctcttttacagtatggtgatttgaactatgattcctagacatttcattatcacttctctaatctgtgtgctccaagtctgtgccaccctcgctctcgtggctaacgcgagtccagactgcattggagcgttcgcctcctacgtgctctttgccttcatcacctgcatctgctgctgtagcatagtctgcctgcttatcaccttcttccagttcgttgactgggtctttgtgcgcatcgcctacctgcgccaccatccccagtaccgcgaccagagagtggcgcaactgttgaggctcatctgataagcatgcgggctctgctactcctcgcgcttgcactagctcccctcgccgcccccttaaccttcaaatcccccacccagtcccccgaagaggttcgaaaatgtaaattccaagaaccctggaaattcctcaaatgctaccagctcaaatcagaaatgcaccccagctggatcatgatcattggaatcgtgaacatccttgcctgtactctcatctcctttgtgatttacccctgctttaactttgggtggaacgcacccgaggcgctctggctcccgcctgatcccgacacaccaccacagcagcagcaaaatcaggcacacgcaccaccacagcctaggccacaatacatgcccatcttagactatgaggccgagccacagcgagccatgcttcctgctattagttacttcaatctaaccggcggagatgactgaccccatggccaacaacaccgtcaacgacctcctggacatggacggccgcggctcggagcagcgactcgcccaactccgcatccgccagcagcaggagagagccgtcaaagagctgcaggatgcggtggccatccaccagtgcaagaaaggcatcttctgcctggtgaagcaggccaagatcaccttcgaggtgacttccaccgaccatcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaacccctaccccctttaccctcaagtaaaaataaagattaaaaaatgattgaattgatcaataaagaatcacttacttgaaatctgaaaccaggtctctgtccatgttttctgtcagcagcacttcactcccctcttcccagctctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtctctgcgcctggccgaccccgtcaccaccaagaacggggctgtcaccctcaagctgggggagggggtggacctcgacgactcgggaaaactcatctccaaaaatgctaccaaggccactgcccctctcagtatttccaacggcaccatttcccttaacatggatacccctttttacaccagcgatggaaaattatccttacaagtttatccaccattaaacatattaagaacacccattatcaacacattagctttagcatataagtcaggtttaggtgtaagtgacaaatcccttgctgttcaattagcttctccactcatttttgatgaaaaaggaaacatagaaattaacttgggaagtgggccattaacagttgcatcaaatcaacttagcattaactgtcaaagaggtgtacatatcactaccgcaggagatgcacttgaaacaaacataagttgggctaaaggcataagatttgaaagtgatgccatagctgcaaacattggcaaaggattagaatttggaaccactagtacagagtccgatgtcacagatgcatttccaattcaagttaaattgggcactggccttacatttgacagcacaggagctattgttgcttggaacaaagaggatgacaagcttacactatggaccacagctgacccatctccaaactgtcacatatattctcaaaaagatgctaagcttactctttgtttgacaaagtgcggcagtcagatactgggcactgtttccctcatagctgttaatactggcagcttaaatccaataacaggaacagtacatactgctcttgtttcacttaaattcgatgcaagtggggttttgcaaaccagttcaacattggataaagaatattggaatttcagaaaaggagatgtaacacctgcagatccctacactaatgctataggttttatgcccaaccttaatgcatatccaaaaaacacaagtgcagctgcaaaaagtcacattgttggaaaagtatacctaaatggtgatgtagcaaagccactggacttgataattacatttaatgaaaccagcgatgaaacctgtacctattgcattaactttcagtggcagtggggagctgatgaatataaaaatgaaacgcttgctgtcagttcattcaccttctcctacattgctaaagaataaaccctgcatgccaacccctttcccacaactatggaaaactctgaagcagaaaaaataaagttcaagtgttttattgattcaacagtttttcacagaattcgagtagttattttccctcctccctcccaactcatggaatacaccaccctctccccacgcacagccttaaacatctgaatgccattggtaatggacatggttttggtctccacattccacacagtttcagagcgagccagtctcgggtcggtcagggagatgaaaccctccgggcactcctgcatctgcacctcaaagttcagtagctgagggctgtcctcggtggtcgggatcacagttatctggaagaagagcgatgagagtcataatccgcgaacgggatcgggcggttgtgccgcatcaggccccgcagcagtcgctgtctgcgccgctccgtcaagctgctgctcaaggggtccgggtccagggactccctgcgcatgatgccgatggccctgagcatcagtcgcctggtgcggcgggcgcagcagcgaatgcggatctcactcaggtcggagcagtacgtgcagcacagcaccaccaagttgttcaacagtccatagttcaacgtgctccaaccaaaactcatctgtggaactatgctgcccacatgtccatcgtaccagatcctgatgtaaatcaggtggcgccccctcaagaacacactgcccatgtacatgatctccttgggcatgtgcaggttcaccacctcccggtaccacatcacccgctggttgaacatgcagccctggataatcctgcggaaccagatggccagcaccgccccgcccgccatgcagcgcagggaccccgggtcctggcagtggcagtgaaggacccaccgctcacggccgtggatcaactgggagctgaacaagtctatgttggcacagcacaggcacacgctcatgcatgtcttcagcactctcagttcctcgggggtcaggaccatgtcccagggcacggggaactcttgcaggacagtgaacccggcagaacagggcaaccctcgcacacaacttacattgtgcatggacagggtatcgcaatcaggcagcaccggatgatcctccaccagagaagcgcgggtctcggtctcctcacagcgaggtaagggggccggtggttggtacggatgatggcgggatgacgctaatcgtgttctggatcgtgtcatgatggagctgtttcctgacattttcgtacttcacgaagcagaacctggtccgggcactgcacaccgctcgtcggcgacggtctcggcgcttcgagcgctcggtgttgaagttatagaacagccactccctcagagcgtgcagtatctcctgagcctcttgggtgatgaaaatcccatccgccctgatggctctgatcacatcgaccacggtggaatgggccagacccagccagatgatgcaattttgttgggtttcggtaacggcgggggagggaagaacaggaagaaccatgattaactttattccaaacggtctcggagcacttcaaaatgcaggtcccggagatggcacctctcgcccccactgtgttggtggaaaataacagccaggtcaaaggtgacacggttctcgagatgttccacggtggcttccagcaaagcctccacgcgcacatccagaaacaagaggacagcgaaagcgggagcgttctctaattcctcaatcatcatattacactcctgcaccatccccagataattttcatttttccagccttgaatgattcgtattagttcctgaggtaaatccaagccagccatgataaaaagctcgcgcagagcgccctccaccggcattcttaagcacaccctcataattgcaagagatcctgttcctggttcacctgcagcagattaacaatgggaatatcaaaatctctgccgcgatccctgagctcctccctcaacaataactgtatgtaatctttcatatcctctccgaaatttttagccataggaccgccaggaataagagaaggagaagccacagtacagataaagcgaagtcctccccagtgagcattgccaaatgtaagattgaaataagcatgctggttagacccggtgatatcttccagattactggacagaaaatcgggcaagcaatctttcagaaactgaacaaaagaaaagtcctctaggtgcacgtttagagcctcgggaacaacgatggaataagtgactgggctgcgctccagcatggttagtgttttttggtgatctgtagaataaaaaataaaacatgcaatattaaaccatgctagcctggcgaacaggtgggtaaatcactctttccagcaccaggcaggctacagggtctccggcgcgaccctcgtagaaactgtcgccatgattgaaaagcatcaccgagagaccttcccggtggccggcatggatgattcgagaagaagcatacactccgggaacattggcgtccgtgagtgaaaaaaagcgacctataaagcctcgaggcactacaatgctcaatcttaattccagcaaagccaccccatgcggatgaagcacaaaattggcaggtgcgtaaaaaatgtaattactcccctcctgcacaggcagcaaagcccccgctccctccagaaacacatacaaagcctcagcgtccatagcttaccgagcacggcaggcgcaagagtcagagaaaaggctgagctctaacctgactgcccgctcctgtgctcaatatatagccctaacctacactgacgtaaaggccaaagtctaaaaatacccgccaaaatgacacacacgcccagcacacgcccagaaaccggtgacacactcaaaaaaatacgtgcgcttcctcaaacgcccaaaccggcgtcatttccgggttcccacgctacgtcacctctcagcgactttcaaattccgtcgaccgttaaaaacgtcactcgccccgcccctaacggtcgccttccccgcagccaatcacaaccccgcatccccaaattcaaacgcctcatttgcatattaacgcgcacaaaaagtttgaggtatattattgatgatg

SEQ ID NO: 115 - protein, 504 aa, Unknown
  Synthetic Construct
MESRNPFQQGLPSGLLSSSFVENMEVPAPECNLRLLASTAGRHAEDPESPVTPGTPTPPAAAAGAAARGGGGPRREPESRSGPSGGGGGGVADLFPELRRVLTRSSSGRERGIKRERHEETSHRTELTVSLMSRRRPESVWWHEVQSTGTDEVSVMHERFSLEQVKTCWLEPEDDWEVAIRNYAKLALRPDKKYKITKLINIRNACYISGNGAEVEICLQERVAFRCCMMNMYPGVVGMDGVTFMNMRFRGDGYNGTVFMANTKLTVHGCSFFGFNNTCIEAWGQVGVRGCSFSANWMGIVGRTKSVLSVKKCLFERCHLGVMSEGEARIRHCASTETGCFVLCKGNAKIKHNMICGASDERGYQMLTCAGGNSHMLATVHVASHARKPWPEFEHNVMTRCNMHLGSRRGMFMPYQCNLNYVKVLLEPDAMSRVSLTGVFDMNVEVWKILRYDESKTRCRACECGGKHARFQPVCVDVTEDLRPDHLVLSCTGTEFGSSGEESD

SEQ ID NO: 116 - protein, 142 aa, Unknown; identical to SEQ ID NO: 3
  Synthetic Construct

SEQ ID NO: 117 - protein, 393 aa, Unknown
  Synthetic Construct
MHPVLRQMRPHHPPPQQQPPPPQPALLPPPQQQQLPATTAAAAVSGAGQSYDHQLALEEGEGLARLGASSPERHPRVQMKRDAREAYVPKQNLFRDRSGEEPEEMRAARFHAGRELRRGLDRKRVLRDEDFEADELTGISPARAHVAAANLVTAYEQTVKEESNFQKSFNNHVRTLIAREEVTLGLMHLWDLLEAIVQNPTSKPLTAQLFLVVQHSRDNEAFREALLNITEPEGRWLLDLVNILQSIVVQERGLPLSEKLAAINFSVLSLGKYYARKIYKTPYVPIDKEVKIDGFYMRMTLKVLTLSDDLGVYRNDRMHRAVSASRRRELSDQELMHSLQRALTGAGTEGESYFDMGADLHWQPSRRALEAAGPPYVEEVDDEVDEEGEYLED

SEQ ID NO: 118 - protein, 589 aa, Unknown
  Synthetic Construct
MQQQPPPDPAMRAALQSQPSGINSSDDWTQAMQRIMALTTRNPEAFRQQPQANRLSAILEAVVPSRSNPTHEKVLAIVNALVENKAIRGDEAGLVYNALLERVARYNSTNVQTNLDRMVTDVREAVAQRERFHRESNLGSMVALNAFLSTQPANVPRGQEDYTNFISALRLMVTEVPQSEVYQSGPDYFFQTSRQGLQTVNLSQAFKNLQGLWGVQAPVGDRATVSSLLTPNSRLLLLLVAPFTDSGSINRNSYLGYLINLYREAIGQAHVDEQTYQEITHVSRALGQDDPGNLEATLNFLLTNRSQKIPPQYALSAEEERILRYVQQSVGLFLMQEGATPSAALDMTARNMEPSMYASNRPFINKLMDYLHRAAAMNSDYFTNAILNPHWLPPPGFYTGEYDMPDPNDGFLWDDVDSSVFSPRPGANERPLWKKEGSDRRPSSALSGREGAAAAVPEAASPFPSLPFSLNSIRSSELGRITRPRLLGEEEYLNDSLLRPEREKNFPNNGIESLVDKMSRWKTYAQEHRDDPSQGAASRGSAARKRRWHDRQRGLMWDDEDSADDSSVLDLGGSGNPFAHLRPRIGRMM

SEQ ID NO: 119 - protein, 530 aa, Unknown
  Synthetic Construct
MMRRAYPEGPPPSYESVMQQAMAAAMQPPLEAPYVPPRYLAPTEGRNSIRYSELAPLYDTTRLYLVDNKSADIASLNYQNDHSNFLTTVVQNNDFTPTEASTQTINFDERSRWGGQLKTIMHTNMPNVNEFMYSNKFKARVMVSRKTPNGVTVTDGSQDILEYEWVEFELPEGNFSVTMTIDLMNNAIIDNYLAVGRQNGVLESDIGVKFDTRNFRLGWDPVTELVMPGVYTNEAFHPDIVLLPGCGVDFTESRLSNLLGIRKRQPFQEGFQIMYEDLEGGNIPALLDVEAYEKSKEESAAAATTAVATASTEVRGDNFASPAAVAAAEAAETESKIVIQPVEKDSKDRSYNVLPDKINTAYRSWYLAYNYGDPEKGVRSWTLLTTSDVTCGVEQVYWSLPDMMQDPVTFRSTRQVSNYPVVGAELLPVYSKSFFNEQAVYSQQLRAFTSLTHVFNRFPENQILVRPPAPTITTVSENVPALTDHGTLPLRSSIRGVQRVTVTDARRRTCPYVYKALGIVAPRVLSSRTF

SEQ ID NO: 120 - protein, 193 aa, Unknown
  Synthetic Construct
MSILISPSNNTGWGLRAPSKMYGGARQRSTQHPVRVRGHFRAPWGALKGRVRSRTTVDDVIDQVVADARNYTPAAAPVSTVDAVIDSVVADARRYARAKSRRRRIARRHRSTPAMRAARALLRRAKRTGRRAMLRAARRAASGASAGRTRRRAATAAAAAIASMSRPRRGNVYWVRDAATGVRVPVRTRPPRT

SEQ ID NO: 121 - protein, 344 aa, Unknown
  Synthetic Construct
MSKRKFKEEMLQVIAPEIYGPAAVVKEERKPRKIKRVKKDKKEEDDVDDMVEFVREFAPRRRVQWRGRKVRPVLRPGTTVVFTPGERSGTASKRSYDEVYGDDDILEQAAERLGEFAYGKRSRSAPKEEAVSIPLDHGNPTPSLKPVTLQQVLPTAAPRRGFKREGEDLYPTMQLMVPKRQKLEDVLETMKVDPDVQPEVKVRPIKQVAPGLGVQTVDIKIPTEPMETQTEPMIKPSTSTMEVQTDPWMPAAPTSGRRPRRKYGAASLLMPNYALHPSIIPTPGYRGTRFYRGHTSRRRKTTTRRHRRRTTAATTAAALVRRVYRRGRAPLTLPRARYHPSIAI

SEQ ID NO: 122 - protein, 77 aa, Unknown; identical to SEQ ID NO: 65
  Synthetic Construct

SEQ ID NO: 123 - protein, 258 aa, Unknown
  Synthetic Construct
MDSDAPGPVMCFRRQMEDINFSSLAPRHGTRPFMGTWSDIGTSQLNGGAFNWSSLWSGLKNFGSTLKTYGNKAWNSTTGQALREKLKEQNFQQKVVDGLASGINGVVDLANQAVQRQINSRLDPVPPAGSVEMPQVEEELPPLDKRGEKRPRPDAEETLLTHTDEPPPYEEAVKLGLPTTRPIAPLATGVLKPESSKPATLDLPPPASRPSTVAKPLPPVAVARARPGGSARPHANWQSTLNSIVGLGVQSVKRRRCY

SEQ ID NO: 124 - protein, 938 aa, Unknown
  Synthetic Construct
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNALAPKAAPNPSQWEETTTGTDGNAATTTTHSFGLAAMKGDNITSDGLQIGTDATSGEEKPIYADKLYQPEPQIGEESWTDTDGTNEKFGGRVLKKDTSMKPCYGSFAKPTNNKGGQAKQKATEGTAVEYDVDMNFFDGRDAAANFTPEVVLYAENVDLETPDTHIVYKPGTSDVSSHVNLGQQAMPNRPNYIGFRDNFIGLMYYNSTGNMGVLAGQASQLNAVVDLQDRNTELSYQLLLDSLGDRTRYFSMWNQAVDSYDPDVRIIENHGIEDELPNYCFPIDAVGITRTYQGIKTQNGQTTTWEKDTSVSTANEIGIGNNLAMEINIQANLWRNFLYANVALYLPDSYKYTPANVTLPTNTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 125 - protein, 211 aa, Unknown
  Synthetic Construct
MACGSSPTGSGEQELRAIIRDLGCGPYFLGTFDKRFPGFMAPHKLACAIVNTAGRETGGEHWLAFAWNPRSNTCYLFDPFGFSDERLKQIYQFEYEGLLRRSALATEDRCITLEKSTQTVQGPRSAACGLFCCMFLHAFVHWPDRPMDKNPTMNLLTGVPNGMLQSPQVEPTLRRNQEALYRFLNAHSAYFRSHRARIEKATAFDRMNQDM

SEQ ID NO: 126 - protein, 801 aa, Unknown
  Synthetic Construct
METQPSPTSPSAPTTADEKQQQQNESLTAPPPSPATSDAAVPDMQEMEESIEIDLGYVTPAEHEEELAVRFQSSSQEDKEQPEQEAENEQSQAGLEHDGDYLHLSGGVDALIKHLARQAIIVKDALLDRTEVPLSVEELSRAYELNLFSPRVPPKRQPNGTCEPNPRLNFYPVFAVPEALATYHIFFKNQKIPVSCRANRTRADALFNLGPGARLPDIASLEEVPKIFEGLGSDETRAANALQGEGGEHEHHSALVELEGDNARLAVLKRTVELTHFAYPALNLPPKVMSAVMDQVLIKRASPISEDEGMQDSEEGKPVVSDEQLARWLGPNATPQSLEERRKLMMAVVLVTVELECLRRFFADAETLRKVEENLHYLFRHGFVRQACKISNVELTNLVSYMGILHENRLGQNVLHTTLRGEARRDYIRDCVYLYLCHTWQTGMGVWQQCLEEQNLKELCKLLQKNLKGLWTGFDERTTASDLADLIFPERLRLTLRNGLPDFMSQSMLQNFRSFILERSGILPATCSALPSDFVPLTFRECPPPLWSHCYLLRLANYLAYHSDVIEDVSGEGLLECHCRCNLCTPHRSLACNPQLLSETQIIGTFELQGPSDEGSAKGGLKLTPGLWTSAYLRKFVPEDYHPFEIRFYEDQSQPPKAELSACVITQGAILAQLQAIQKSRQEFLLKKGRGVYLDPQTGEELNPGFPQDAPRKQEAESGAAARGGFGGRLGEQQSGRGDGGRLGQHSGRGGQPARQSGRRGGGRGGGGRSSRRQTVVLGGGESKQHGYHLRSGSGSRSTPQ

SEQ ID NO: 127 - protein, 227 aa, Unknown; identical to SEQ ID NO: 70
  Synthetic Construct

SEQ ID NO: 128 - protein, 211 aa, Unknown
  Synthetic Construct
MKVFVVCCVLSIIKAEISDYSGLNCGVSASINRSLTFTGNETELQLQCKPHKKYLTWLYQGSPIAVVNHCDDDGVLLNGPANLTFSTRRSKLLLFRPFLPGTYQCISGPCHHTFHLIPNTTSSPAPLPTNNQTNHQRYRRDLVSESNTTHTGGELRGPDSSGIYYGPWEVVGLIALGLVAGGLLALCYLYLPCFSYLVVLCCWFKKWGRSP

SEQ ID NO: 129 - protein, 264 aa, Unknown
  Synthetic Construct
MPRKRNSHNIHTPCFLQTMRLLIFVIITLSINNAHGYANIQKTLYVGSDSTLEGTQSQARVSWYFYKGNDKPITLCKGDQGRITKPPITFSCTRTNLTLLSITKQYAGTYYSTNFHSGQDKYYTVKVENPTTPRTTTKPTTTKKPTTPKKPTTPKTTKTTTTKTTTTEPTTTSTTLAITTHTHTELTSQATTENGFALLQKGENSSSSLMPTTPSEEIPKSMVGIIAAVVVCMVIIILCMMYYACYYRKHRLNNKLDPLLNVDF

SEQ ID NO: 130 - protein, 208 aa, Unknown
  Synthetic Construct
MKILSLFVFSIIITSAICESVDKDVTVTTGSNYTLKGPSSGMLSWYCYFGNDDKQTELCNFQNGKTKNSKIDNYQCQGTDLVLMNITKAYAGSYSCPGQNTEEMIFYKLIVVDPTTPAPTTTTTKAHTTDTQETTPEAEAEIAKQIHEDSFVANTPTHPGPQCPGPLVSGIVGVLCGLAVIIICMFIFACCYRRLHRQKSDPLLNLYV

SEQ ID NO: 131 - protein, 299 aa, Unknown
  Synthetic Construct
MKALSTLVFLSLIGIVFTSQITRVRFIKYVNVTEGDNITLAGVEGAQNTTWTKYHLGWKDICTWNVTYFCIGVNLTIVNANQSQNGLIKGQSVSVTSDGYYTQHSFNYNITVIPLPTPSPPSTTQTTQTTHTTQNSTTTMQTTQTTTSPQPTTTTAEASSSPKIEVAFLLLPPSSSPTASTNEQTTEFLSTTQSSTTATSSAFSSTANLTSLSSTPISNATTSPAPLPTPLKQSESSTQLQITLLIVIGVVILAVLLYFIFCRRIPNAKPAYKPIVIGTPEPLQVEGGLRNLLFSFTVW

SEQ ID NO: 132 - protein, 91 aa, Unknown; identical to SEQ ID NO: 17
  Synthetic Construct

SEQ ID NO: 133 - protein, 143 aa, Unknown
  Synthetic Construct
MRALLLLALALAPLAAPLTFKSPTQSPEEVRKCKFQEPWKFLKCYQLKSEMHPSWIMIIGIVNILACTLISFVIYPCFNFGWNAPEALWLPPDPDTPPQQQQNQAHAPPQPRPQYMPILDYEAEPQRAMLPAISYFNLTGGDD

SEQ ID NO: 134 - protein, 442 aa, Unknown
  Synthetic Construct
MSKKRARVDDGFDPVYPYDADNAPTVPFINPPFVSSDGFQEKPLGVLSLRLADPVTTKNGAVTLKLGEGVDLDDSGKLISKNATKATAPLSISNGTISLNMDTPFYTSDGKLSLQVYPPLNILRTPIINTLALAYKSGLGVSDKSLAVQLASPLIFDEKGNIEINLGSGPLTVASNQLSINCQRGVHITTAGDALETNISWAKGIRFESDAIAANIGKGLEFGTTSTESDVTDAFPIQVKLGTGLTFDSTGAIVAWNKEDDKLTLWTTADPSPNCHIYSQKDAKLTLCLTKCGSQILGTVSLIAVNTGSLNPITGTVHTALVSLKFDASGVLQTSSTLDKEYWNFRKGDVTPADPYTNAIGFMPNLNAYPKNTSAAAKSHIVGKVYLNGDVAKPLDLIITFNETSDETCTYCINFQWQWGADEYKNETLAVSSFTFSYIAKE

SEQ ID NO: 135 - DNA, 32040 bp, Unknown
  Simian adenovirus A1316
  CDS (31598)..(31999): E3\14.7K
catcatcaataatatacctcaaactttttgtgcgcgttaatatgcaaatgaggcgtttgaatttggggatgcggggttgtgattggctgcggggaaggcgaccgttaggggcggggcgggtgacgtttcgatgacgtggccgtgaggcggagccggtttgcaagttctcgtgggaaaagtgacgtcaaacgaggtgtggtttgaacacggaaatactcaattttcccagcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtaggcgtcagctgatcgccagggtatttaaacctgcgctctctagtcaagaggccactcttgagtgccagcgagtagagctttctcctccgcgccgcgagtcagatctacactttgaaagatgaggcacctgagagacctgcccggtaatgttttcctggctactgggaacgagattctggaattggtggtggacgccatgatgggtgacgaccctcccgagccccctactccatttgaggcgccttcgctgtacgatttgtatgatctggaggtggatgtgcccgagaacgaccccaacgaggaggcggtgaatgatttgtttagcgatgccgcgctgctggctgccgagcaggctaatacggactctggctcagacagcgattcctctctgcataccccgagacccggcagaggtgagaaaaagatccccgagcttaaaggggaagagctcgacctgcgctgctatgaggaatgcttgcctccgagcgatgatgaggaggacgaggaggcgattcgagctgcagcgaaccagggagtgaaagcagcgagcgagggctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagttggggaggcagggggtgactggatgctgactggtttatttatgtatgtattctttatgtgtaggtcccgtctctgacgcagatgagacccccacttcagagtgcatttcatcacccccagaaattggcgaggaaccgcccgaagatattattcatagaccagttgcagtgagagtcaccgggcggagagcagctgtggagagtttggatgacttgctacagggtggggatgaacctttggacttgtgtacccggaaacgccccaggcactaagtgccacacatgtgtgtttacttaaggtgatgtcagtatttatagggtgtggagtgcaataaaatccgtgttgactttaagtgcgtggtttatgactcaggggtggggactgtgggtatataagcaggtgcagacctgtgtggtcagttcagagcaggactcatggagatctggacggtcttggaagactttcaccagactagacagctgctagagaactcatcggagggagtctcttacctgtggagattctgcttcggtggggctctagctaagctagtccatagggccaaacaggattataaggatcaatttgaggatattttgagagagtgtcctggtatttttgactctctcaacttgggccatcagtctcactttaaccagagtattctgagagcccttgacttttctactcctggcagaactaccgccgcggtagccttttttgcctttatccttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagttaccccaggaacaccaacgccgccagcagccgcagcaggagcagcagcaagaggaggaggaggaccgagaagagaacccgagagccggtctggaccctccggtggtggaggaggaggagtagctgacttgtttcccgagctgcgccgggtgctgactaggtcttccagtggacgggagagggggattaagcgggagaggcatgaggagactagtcacagaactgaactgactgtcagtctgatgagccgcaggcgcccagaatcggtgtggtggcatgaggtgcagtcaactggcacagatgaggtgtcagtgatgcatgagaggttttctctagaacaagtcaagacttgttggttggagcctgaggatgattgggaggtagccatcaggaattatgccaagctggctctgaggccagacaagaagtacaagattactaagctgataaatatcagaaatgcctgctacatctcagggaatggggctgaagtggagatctgtcttcaggaaagggtggctttcagatgctgcatgatgaatatgtacccgggagtggtgggcatggatggggtcacctttatgaacatgaggttcaggggagatgggtataatggcacggtctttatggccaataccaagctgacagtccatggctgctccttctttgggtttaataacacctgtatcgaggcctggggtcaggtcggtgtgaggggctgcagtttttcagccaactggatggggatcgtgggcaggaccaagagtgtgctgtctgtgaagaaatgcttgttcgagaggtgccacctgggggtgatgagcgagggcgaagccagaatccgccactgcgcctctaccgagacgggctgctttgtgctgtgcaagggcaatgctaagatcaagcataatatgatctgtggagcctcggacgagcgcggctaccagatgctgacctgcgccggtgggaacagccatatgctagccaccgtgcatgtggcctcccatgctcgcaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaagtgtggaagattctgagatatgatgaatccaagaccaggtgccgagcctgcgagtgcggagggaagcatgccaggttccagcccgtgtgtgtggatgtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagcatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctactacggcactctggtggccaactcgagttccaccaataatcccgccagcctgaacgaggagaagctgctgctgctgatggcacagctcgaggccttgacccagcgcctgggcgagctgacccagcaggtggctcagctgcaggagcagacgcgggctgcggttgccacggtgaaatccaaataaaaaatgattcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgttgcacaatatctttgaggaggagactgatggccacgggcagccctttggtgtaggtgtttacaaatctgttaagctgggagggatgcatgcggggggagatgaggtgcatcttggcctggatcttgagattggcgatgttgccgcccagatcccgcctggggttcatgttgtgcaggaccaccagcacggtgtatccggtgcacttggggaatttatcatgcaacttggaagggaaggcgtgaaagaatttggcgacgcccttgtgcccgcccaggttttccatgcactcatccatgatgatggcgatgggcccgtgggcggcggcctgggcaaagacgtttcgggggtcggacacatcatagttgtggtcctgggtgagatcatcataggccattttaatgaatttggggcggagggtgcccgattgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttgcggagcagctgtgacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcttcgagcggtgtgccgcggtcctcctcgtagaggaaccccgcccactccgagacgaaagcccgggtccaggccaagacaaaggaggccacgtgggacgggtagcggtcgttgtccaccagcgggtccaccttctccagggtatgcaaacacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggccgcgatgttgagctgcacgtactcgcgcgccacgcacttccattcggggaagacggtggtcagctcgtcgggcacgattctgacctgccagccccgattatgcagggtgatgaggtccacgctggtggccacctcgccgcgcaggggctcgttggtccagcagaggcgcccgcccttgcgcgagcagaaggggggcagggggtccagcatgacctcgtcgggggggtcggcatcgatggtgaagatgccgggcaggagatcggggtcgaagtagctgatggaagtgcccagatcgtccagggaagcttgccattcgcgcacagccagcgcgcgctcgtagggactgaggggcgtgccccagggcatggggtgggtgagcgcggaggcgtacatgccgcagatgtcgtagacgtagaggggctcctcgaggatgccgatgtaggtggggtagcagcgccccccgcggatactggcgcgcacgtagttatacagctcgtgcgagggcgcgaggagaccggggcccaggttggtgcgactgggcttttcggcgcggtagacgatctggcggaagatggcatgcgagttggaggagatggtgggcctttggaagatattgaagtgggcgtgggggaggccgaccgagtcgcggatgaagtgggcgtaggagtcttgcagcttggcgacgagctcggcggtgacgaggacgtccagagcgcagtagtcgagggtctcctggatgatgtcatacttgagctggcccttttgtttccacagctcgcggttgagaaggaactcttcgcggtccttccagtactcttcgagggggaacccgtcctgatctgcacggtaagagcctagcatgtagaactggttgacggctttgtaggcgcagcagcccttctccacggggagggcgtaggcctgggcggccttgcgcagggaggtgtgcgtgagggcgaaagtgtccctgaccatgactttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttgatgttgtggcccacgatgtaaagttccacgaaccgtgggcggcccttgacgtggggcagcttcttgagttcctcgtaggtgagctcgtcggggtcgctgaggccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcggtcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgaaccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccacgcgggaggcaggtccagacctcggcgcgagcgggtcggagagcgaggacgagagcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccatgcccctggggtgtgaccaccgtcccccgtttcttcttgggcggctggggcgacgggggcggtgcttcggcttccatggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcttggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcgacggagcggcatctcgctgacgtcgcccagcgcctccaaacgttccatggcctcgtaaaagtccacggcgaagttgaaaaactgggagttgcgcgccgagacggtcaactcctcctccagaagacggataagctcggcgatggtggcgcgcacctcgcgctcgaaggcccccgggagttcctcctcttcctcttcttcctcctcctccactaacatctcttctacttcctcctcaggcggcagtggtggcgggggagggggcctgcgtcgccggcggcgcacgggcagacggtcgatgaaacgctcgatggtctcgccgcgccggcgtcgcatggtctcggtgacggcgcgcccgtcctcgcggggcctcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggccggaaatgagactagtaagcgcggaaagcgaccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgtttttttgtttttgccagatgcatcccgtactgcggcagatgcgcccccaccaccctccaccgcaacaacagccccctcctccacagccggcgcttctgcccccgccccagcagcagcaacttccagccacgaccgccgcggccgccgtgagcggggctggacagagttatgaccaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctaagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggccggtcccccctacgtagaagaggtggacgatgaggtggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcgcccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcgccgaggaggagcgcatcctgcgatacgtgcagcagagcgtgggcctgttcctgatgcaggagggggccactcccagcgccgcgctcgacatgaccgcgcgtaacatggagcccagcatgtacgccagcaaccgcccgttcatcaataagctgatggactacttgcatcgggcggccgccatgaactctgactatttcaccaacgccattctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgcccgtcctcggcgctgtccgggcgcgagggtgctgccgcggcggtgcccgaggccgccagtcctttcccgagcttgcccttctcgctgaacagtatccgcagcagcgagctgggcaggatcacgcgcccgcgcttgctgggcgaggaggagtacttgaatgactccttgctgagacccgagcgggagaagaacttccccaataacgggatagagagcctggtggacaagatgagccgctggaagacgtatgcgcaggagcacagggacgatccgtcgcagggggccgcgagccggggcagcgccgcccgtaaacgccggtggcacgacaggcagcggggactgatgtgggacgatgaggattccgccgacgacagcagcgtgttggacttgggtgggagtggtaacccgttcgctcacctgcgcccccgcatcgggcgcatgatgtaagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgccaaacgtgaacgagttcatgtacagcaacaagttcaaggcgcgggtgatggtctcccgcaagacccccaacggggtgacagtgacagatggtagtcaggatatcttggagtatgagtgggtggagtttgagctgcccgaaggcaacttctcggtgaccatgaccatcgacctgatgaacaacgccatcatcgacaattacttggcggtggggcggcagaacggggtcctggaaagcgacatcggcgtgaagttcgacactaggaacttcaggctgggctgggaccccgtgaccgagctggtcatgcccggggtgtacaccaacgaggccttccatcccgatattgtcttgctgcccggctgcggggtggacttcaccgagagccgcctcagcaacctgctgggcattcgcaagaggcagcctttccaggagggtttccagatcatgtacgaggatctggaggggggcaacatccccgcgctcctggatgtcgaggcctatgagaaaagcaaggaggagagcgctgccgcggcgaccacagccgtagccaccgcctctaccgaggtcaggggcgataattttgccagccctgcagcagtggcagcggccgaggcggctgaaaccgaaagtaagatagtcattcagccggtggagaaggatagcaaggacaggagctacaacgtgctgccggacaagataaacaccgcctaccgcagctggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgacaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaagcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgatgtggacgatatggtggagtttgtgcgcgagttcgcccccaggcggcgcgtgcagtggcgcgggcggaaggtgcgaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgctccgcgccgaaggaagaagcggtgtccatcccgctggaccacggcaaccccacgccgagcctcaagcccgtgaccctgcagcaggtgctgccgaccgcggcgccgcgaagggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagatccccacggagcccatggaaacgcagaccgagcccatgatcaagcccagcaccagcaccatggaggtgcagacggatccctggatgccagccgcccccaccagcgggcgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccacccgccgccaccgtcgccgcacaaccgctgcaactaccgccgccgccctggtgcggagagtgtaccgccgcggccgcgcgcctctgaccctgccgcgcgcgcgctaccacccgagcatcgccatttaaaactttcgcctgctttgcagatggccctcacatgccgcctccgcgtccccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcaacaaggcgtggaacagcaccacagggcaggcgctgagggaaaagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtgaaactgggtctgcccaccacgcggcccatcgcgcccctggccaccggggtgctgaaacccgagagtagtaagcccgcgaccctggacttgcctcctcccgcttcccgcccctccacagtggctaagcccctgccgccggtggccgtggcccgcgcgcgacccgggggctccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgctgtcgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacgccctggcccctaaagccgctcctaatcctagccagtgggaggaaaccactactggaacggatggaaatgctgctactacaactacacatagttttggcctggctgctatgaaaggggacaatattacatctgacggtttgcaaataggaacagatgctacttctggagaggaaaaacccatctatgcagataaactgtaccagccagaaccccaaataggggaagagtcatggactgatactgatggaaccaatgaaaaattcggaggaagagtccttaaaaaggacacaagcatgaaaccctgctacgggtcatttgccaaaccaaccaataacaaaggtggtcaagcaaaacaaaaggcaactgaaggaaccgctgtagaatatgatgtagacatgaacttttttgatggtagagatgcagctgctaactttactccagaagtagtgttgtatgctgaaaatgtggatttggaaactccagatacacatattgtatacaaaccaggaacctcagatgtgagttcccatgttaatttgggacagcaagccatgcccaacagacccaactacattggtttcagagacaactttattggtctcatgtattacaacagcactggcaatatgggggtgctggccggtcaggcttctcagctgaatgctgtggttgacttgcaagacagaaacactgaactgtcctaccagctgttgcttgactctttgggtgacagaactcggtatttcagtatgtggaatcaggcggtggacagctatgatcctgatgtgcgcatcattgaaaatcatggtatagaagatgagcttcccaactattgctttcctattgacgctgtgggtattactagaacttatcaaggtatcaaaacgcaaaatggtcaaactacaacttgggaaaaggacaccagtgttagtacggccaatgaaataggcattggcaacaatcttgccatggaaatcaacatccaagccaacctgtggaggaacttcctctacgccaacgtggccctgtacctgcccgattcttacaagtacacaccggccaacgtcaccctgcccaccaataccaacacctacgattacatgaacggccgggtggtggcgccctcgctggtggacgcctacatcaacatcggggcgcgctggtcgctggaccccatggataacgtgaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagctgctatggcctgtgggtcctcgcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgtcgcagcgccctggccaccgaggaccgctgcatcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaaaccgtgtgtgtatgttaaaatatcttttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcattggccatcccgaagggggtcatcttgcaggtctgccttcccatggtgggcacgcagccgggcttgtggttgcaatcgcagtgcagggggatcagcatcatctgggcctggtcggcgttcattcccgggtacatggccttcatgaaagcctccaattgcctaaaagcttgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggttccgtgcaggcaccgcagcttgccctcggcctcggtgcatccgtgcagccacagcgcgcacccggtgcactcccagttcttgtgggcgatctgggaatgcgcgtgcacgaacccctgcaggaagcggcccatcatggtcgtcagagtcttgttgctagtgaaggtcagcgggatgccgcggtgctcctcattgatgtacaggtggcagatgcggcggtacacctcgccctgctcgggcatcagctggaaattggctttcaggtcggtctccacgcggtagcggtccatcagcatagtcatgatttccatgcccttctcccaggccgagacgatgggcaggctcatagggttcttcaccatcatcttagcactagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacatcctgcaggaccacatgcttggtcttgcggggtttcttcttgggcggcagcggtggtggagatgcttgtggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccaccgccgacgagaagcagcagcagcagaatgaaagcttaaccgctccgccgcccagccccgccacctccgacgcggcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatgacggcgactacctccacctgagcggaggggtggacgcgctcatcaagcatctggcccgacaggccatcatcgtcaaggacgcgctgctcgaccgcaccgaggtgcccctcagcgtggaggagctcagccgcgcctacgagctcaacctcttctcgccgcgtgtgccccccaagcgccagcccaacggcacctgcgagcccaacccgcgcctcaacttctacccggttttcgcggtgcccgaggccctggccacctaccacatcttttttaagaaccaaaagatccccgtctcctgccgcgccaaccgcacccgcgccgacgcccttttcaacctgggccccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctacccctcagagtttggaagagcggcgcaagctcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgattgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttcagccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggtttcccccaggatgccccgaggaaacaagaagctgaaagtggagctgccgcccgtggaggatttggaggaagactgggagagcagcagtcaggcagaggagatggaggaagactgggacagcactcaggcagaggaggacagcctgcaagacagtctggaagacgaggaggtggcagaggaggaggtggaagaagcagccgccgccagaccgtcgtcctcggcggaggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaacttcccccgcaacatcttgcattactaccgtcacctccacagcccctactacttccaagaagaggcagcagcagaaaaagaccatcagcagaaaaccagctagaaaatccacagcggcaggtggactgaggatcgcggcgaacgagccggcgcagactcgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcgtatcttcagccagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccggtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccggcacctatcagtgcatctcgggaccctgccatcacaccttccacctgatcccgaataccacctcttccccagcgccgctccccactaacaaccaaactaaccaccaacgctaccgacgcgacctcgtttctgaatctaataccacccacaccggaggtgagctccgaggtcctgattcctctgggatttattacggcccctgggaggtggtggggttaatagctttaggcttagtggcgggtgggcttttggctctctgctacctatacctcccttgcttttcctacttagtggtgctttgttgctggtttaaaaaatggggaagatcaccctagtgtgcggtgtgctggtgacggtggtgctttcgattctgggagggggaagcgcggctgtagtgacggagaagaaggccgatccctgcttgactttcaaccccgataaatgccagctgagttttcagcccgaaggcaatcggtgcatagtgctgatcaagtgcggatgggaatgcaaggatgtgagaatccagcacaataacaagacgcggaacaatactctcgcgtccacatggcagcccggggaccccgagtggtacaccgtctctgtccctggtgctgacggctccctccgcacggtgaacaacactttcatttttgagcacatgtgcgaaaccgccatgttcatgagcaagcagtacggcatgtggcctccgcgtaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacattcacacaccttgttttttacagacaatgcgtctgttaatttttgttatcattacactcagcattaataatgcccatggctatgcaaatatacaaaaaaccctctatgtaggctctgactctacattagaaggtactcaatctcaagccagggtttcatggtatttttataaaggcaatgataaaccaattactctttgcaaaggtgatcaggggcgcataacaaagccacctatcacatttagctgcaccagaacaaacctcacgcttttatccattacaaaacaatatgctggcacttattacagcacaaattttcatagtgggcaagataaatattatactgttaaggtagaaaaccctactacccctagaacaactacaaagcccaccacaactaagaagcccactacacctaagaagcctaccacgcccaaaaccactaagacaacaactactaagaccactaccacagagccaaccacgaccagcaccacacttgctataactacacacacacacactgagctgacctcgcaggcaactactgaaaatggttttgccctactgcagaagggggagaacagtagcagcagtcttatgcctactacccccagtgaggaaatacccaagtccatggttggcattatcgctgctgtagtggtgtgtatggtgattatcatcttgtgcatgatgtactatgcctgctactacagaaaacacaggctgaacaacaagctggaccccctactgaatgttgatttttaattttttagaaccatgaagatcctaagcctttttgttttttctataattattacctctgctatttgtgaatcagtggataaggacgttactgtcaccactggctctaattatacactaaaagggccttcctcaggtatgctttcgtggtattgttattttggaaatgatgataaacagacagagctatgtaattttcagaacggcaaaaccaaaaattctaaaatagataactatcaatgccagggtactgatttagtactgatgaatatcacgaaagcatatgctggcagttattcatgtcctggacaaaacaccgaggaaatgattttttacaaattaattgtagttgaccctactactccagcaccaaccaccacaactaccaaggcacataccacagacacacaggaaaccactccagaggcagaagcagagatagcaaagcagattcatgaagattcctttgttgccaatacccccacacaccccggaccgcaatgtccagggccattagtcagcggcattgtcggtgtgctttgcgggttagcagttataatcatctgcatgttcatttttgcttgctgctacagaaggcttcaccgacaaaaatcagacccactgctgaacctctatgtttaatttttgattttccagagccatgaaggcacttagcactttagtatttttgtccttgattggcattgtttttactagtcaaattaccagggttagatttatcaaatatgttaatgttactgaaggagataatatcacactagcaggtgtagaaggtgcccaaaacaccacctggacaaaataccatctcgggtggaaagatatttgcacctggaatgtcacttatttttgcataggagttaatcttaccattgtcaatgctaatcaatctcagaatggattaattaaaggccaaagtgttagtgtgaccagtgatgggtattatacccagcatagtttcaactacaacatcactgtcataccactgcccacacctagtccacctagcactactcaaaccacacaaacaactcacactacacagaactccacaactaccatgcagaccactcagacaactacatcccctcagcccaccaccactacagcagaggcgagtagctcacctaaaattgaagtggcatttttgttactgccaccatctagcagtcccactgctagtaccaatgagcagactactgaatttttgtccactactcagagcagcaccacagctacctcgagtgccttctctagcaccgccaatctcacctcgctttcctctacgccaatcagtaacgctactacctcccccgctcctcttcccactcctctgaagcaatccgagtctagcacgcagctgcagatcaccctgctcattgtgatcggggtggtcatcctggcagtgctgctctactttatcttctgccgccgcatccccaacgcgaaaccggcctacaagcccattgttatcgggacgccggagccgcttcaggtggagggaggtctaaggaatcttctcttctcttttacagtatggtgatttgaactatgattcctagacatttcattatcacttctctaatctgtgtgctccaagtctgtgccaccctcgctctcgtggctaacgcgagtccagactgcattggagcgttcgcctcctacgtgctctttgccttcatcacctgcatctgctgctgtagcatagtctgcctgcttatcaccttcttccagttcgttgactgggtctttgtgcgcatcgcctacctgcgccaccatccccagtaccgcgaccagagagtggcgcaactgttgaggctcatctgataagcatgcgggctctgctactcctcgcgcttgcactagctcccctcgccgcccccttaaccttcaaatcccccacccagtcccccgaagaggttcgaaaatgtaaattccaagaaccctggaaattcctcaaatgctaccagctcaaatcagaaatgcaccccagctggatcatgatcattggaatcgtgaacatccttgcctgtactctcatctcctttgtgatttacccctgctttaactttgggtggaacgcacccgaggcgctctggctcccgcctgatcccgacacaccaccacagcagcagcaaaatcaggcacacgcaccaccacagcctaggccacaatacatgcccatcttagactatgaggccgagccacagcgagccatgcttcctgctattagttacttcaatctaaccggcggagatgactgaccccatggccaacaacaccgtcaacgacctcctggacatggacggccgcggctcggagcagcgactcgcccaactccgcatccgccagcagcaggagagagccgtcaaagagctgcaggatgcggtggccatccaccagtgcaagaaaggcatcttctgcctggtgaagcaggccaagatcaccttcgaggtgacttccaccgaccatcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaacccctaccccctttaccctcaagtaaaaat

SEQ ID NO: 136 - protein, 134 aa, Unknown
  Synthetic Construct
MTDPMANNTVNDLLDMDGRGSEQRLAQLRIRQQQERAVKELQDAVAIHQCKKGIFCLVKQAKITFEVTSTDHRLSYELLQQRQKFTCLVGVNPIVITQQSGDTKGCIHCSCDSPECVHTMIKTLCGLRDLLPMN

SEQ ID NO: 137 - DNA, 870 bp, Unknown
  Simian adenovirus A1316
  CDS (7)..(574): E1a
  CDS (659)..(864): E1a
tgaaagatgaggcacctgagagacctgcccggtaatgttttcctggctactgggaacgagattctggaattggtggtggacgccatgatgggtgacgaccctcccgagccccctactccatttgaggcgccttcgctgtacgatttgtatgatctggaggtggatgtgcccgagaacgaccccaacgaggaggcggtgaatgatttgtttagcgatgccgcgctgctggctgccgagcaggctaatacggactctggctcagacagcgattcctctctgcataccccgagacccggcagaggtgagaaaaagatccccgagcttaaaggggaagagctcgacctgcgctgctatgaggaatgcttgcctccgagcgatgatgaggaggacgaggaggcgattcgagctgcagcgaaccagggagtgaaagcagcgagcgagggctttagcctggactgtcctactctgcccggacacggctgtaagtcttgtgaatttcatcgcatgaatactggagataagaatgtgatgtgtgccctgtgctatatgagagcttacaaccattgtgtttacagtaagtgtgattaactttagttggggaggcagggggtgactggatgctgactggtttatttatgtatgtattctttatgtgtaggtcccgtctctgacgcagatgagacccccacttcagagtgcatttcatcacccccagaaattggcgaggaaccgcccgaagatattattcatagaccagttgcagtgagagtcaccgggcggagagcagctgtggagagtttggatgacttgctacagggtggggatgaacctttggacttgtgtacccggaaacgccccaggcactaagtg

SEQ ID NO: 138 - protein, 258 aa, Unknown
  Synthetic Construct
MRHLRDLPGNVFLATGNEILELVVDAMMGDDPPEPPTPFEAPSLYDLYDLEVDVPENDPNEEAVNDLFSDAALLAAEQANTDSGSDSDSSLHTPRPGRGEKKIPELKGEELDLRCYEECLPPSDDEEDEEAIRAAANQGVKAASEGFSLDCPTLPGHGCKSCEFHRMNTGDKNVMCALCYMRAYNHCVYSPVSDADETPTSECISSPPEIGEEPPEDIIHRPVAVRVTGRRAAVESLDDLLQGGDEPLDLCTRKRPRH

SEQ ID NO: 139 - DNA, 36770 bp, Unknown
  Simian adenovirus A1322
  CDS (1605)..(2186): E1b\19K
  CDS (3512)..(3940): pIX
  misc_feature (3999)..(5623): IVa2    complement (3999..5332,5611..5623)
  misc_feature (5102)..(13893): pol    complement (5102..8680,13885..13893)
  misc_feature (8479)..(13893): pTP    complement (8479..10422,13885..13893)
  misc_feature (8962)..(8962): n is a or g
  misc_feature (8974)..(8974): n is c or g
  misc_feature (9130)..(9130): n is a or g
  misc_feature (10003)..(10003): n is a or g
  CDS (10873)..(12054): 52K
  CDS (12078)..(13859): pIIIa
  CDS (13938)..(15566): penton
  CDS (15570)..(16151): pVII
  misc_feature (15785)..(15785): n is c or g
  CDS (16193)..(17230): V
  CDS (17251)..(17484): pX
  CDS (17516)..(18289): pVI
  CDS (18396)..(21218): hexon
  CDS (21240)..(21869): protease
  misc_feature (21948)..(23486): DBP    complement (21948..23486)
  CDS (23509)..(25902): 100K
  CDS (26510)..(27190): pVIII
  CDS (27194)..(27511): E3\12.5K
  CDS (28073)..(28597): E3\gp19K
  CDS (28637)..(29356): E3\CR1-beta
  CDS (29372)..(29992): E3\CR1-gamma
  CDS (30902)..(31174): E3\RID-alpha
  CDS (31183)..(31614): E3\RID-beta
  CDS (32270)..(33595): fiber
  misc_feature (33722)..(34884): E4\orf6/7    complement (33722..33973,34699..34884)
  misc_feature (33970)..(34884): E4\orf6    complement (33970..34884)
  misc_feature (34775)..(35140): E4\orf4    complement (34775..35140)
  misc_feature (35149)..(35502): E4\orf3    complement (35149..35502)
  misc_feature (35499)..(35888): E4\orf2    complement (35499..35888)
  misc_feature (35939)..(36316): E4\orf1    complement (35939..36316)
  repeat_region (36653)..(36674): ITR    complement (36653..36674)
  misc_feature (36693)..(36693): n is a, c, g, or t
  misc_feature (36755)..(36755): n is a, c, g, or t
catcatcaataatatacctcaaacttttggtgcgcgttaatatgcaaatgaggcgtttgaatttggggagggaggaaggtgattggctgcgggagcggcgaccgttaggggcggggcgggtgacgttttgatgacgtggccatgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggtagggaggagtatttgccgagggccgagtagactttgaccgattacgtgggggtttcgattaccgtgtttttcacctaaatttccgcgtacggtgtcaaagtccggtgtttttacgtaggtgtcagctgatcgccagggtatttaaacctgcgctctccagtcaagaggccactcttgagtgccagcgagaagagttttctcctccgcgccgcgagtcagatctacactttgaaagatgaggcacctgagagacctgcccgatgagaaaatcatcatcgcttccgggaacgagattctggaactggtggtaaatgccatgatgggcgacgaccctccggagccccccaccccatttgagacaccttcgctacacgatttgtatgatctggaggtggatgtgcccgaggacgaccccaacgaggaggcggtaaatgatttatttagcgatgccgcactgctagctgccgaggaggcttcgagccctagctcagacagcgactcttcactgcatacccctagacccggcagaggtgagaaaaagatccccgagcttaaaggggaagagatggacttgcgctgctatgaggaatgcttgcccccgagcgatgatgaggacgagcaggcgatccagaacgtagcgagccagggagtgcaagccgccagcgagagctttgcgctggactgcccgcctctgcccggacacggctgtaagtcttgtgaatttcatcgcttgaatactggagataaagctgtgttatgtgcactttgctatatgagagcttacaaccattgtgtttacagtaagtgtgattaagttgaactttagagggaggcagagagcggggtgactgggcgatgactggtttatttatgtatatatgttctttatataggtcccgtctctgacgcagatgatgagacccccactacagagtccatttcgtcacccccagaaattggcacatctccacctgagaatattgttagaccagttcctgttagagccactgggaggagagcagctgtggaatgtttggatgacttgctacagggtggggatgaacctttggacttgtgtacccggaaacgccccaggcactaagtgccacacatgtgtgtttacttgaggtgatgtcagtatttatagggtgtggagtgcaataaaaaatgtgttgactttaagtgcgtgttttatgactcaggggtggggactgtgggtatataagcaggtgcagacctgtgtggtcagttcagagcaggactcatggagatctggacggtcttggaagactttcatcagactagacagctgctagagaactcatcggaggaagtctcttacctgtggagattttgcttcggtggggctctagctaagctagtctatagggccaaacatgattataaggatcaatttgaggatattttgagagagtgtcctggtatttttgactctctcaacttgggccatcagtctcactttaaccagagtattctgagagcccttgacttttctactcctggcagaactaccgccgcggtagccttttttgcctttatccttgacaaatggagtcaagaaacccatttcagcagggattaccgtctggactgcttagcagtagctttgtggagaacatggaggtgccagcgcctgaatgcaatctccggctacttgccagtacagccggtagacacgctgaggatcctgagtctccagtcaccccaggaacaccaacgccgccagcagccgcagcaggagcagcagcaagaggaggaggaggaggaccgagaagagaacccgagagccggtctggaccctccggtggcggaggaggaggagtagctgacttgtttcccgagctgcgccgggtgctgactaggtcttccagtggacgggagagggggattaagcgggagaggcatgaggagactagtcacagaactgaactgactgtcagtctgatgagccgcaggcgcccagaatcggtgtggtggcatgaggtgcagtcgcaggggatagatgaggtctcagtgatgcatgagaaatattccctagaacaagtcaagacttgttggttggagcccgaggatgattgggaggtagccatcaggaattatgccaagctggctctgaagccagacaagaagtacaagattaccaaactgattaatatcagaaattcctgctacatttcagggaatggggccgaggtggagatcagtacccaggagagggtggccttcagatgctgcatgatgaatatgtacccgggagtggtgggcatggatggggtcacctttatgaacatgaggttcaggggagatgggtataatggcacggtctttatggccaataccaagctgacagtccatggctgctccttctttgggtttaataacacctgtatcgaggcctggggtcaggtcggtgtgaggggctgcagtttttcagccaactggatggggatcgtgggcaggaccaagagtgtgctgtctgtgaagaaatgcttgttcgagaggtgccacctgggggtgatgagcgagggcgaagccagaatccgccactgcgcctctaccgagacgggctgctttgtgctgtgcaagggcaatgctaagatcaagcataatatgatctgtggagcctcggacgagcgcggctaccagatgctgacctgcgccggtgggaacagccatatgctagccaccgtgcatgtggcctcccatgctcgcaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggatgtgtggaagattctgagatatgatgaatccaagaccaggtgccgagcctgcgagtgcggagggaagcatgccaggttccagcccgtgtgtgtggatgtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagcatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctactacggcactctggtggccaactcgagttccaccaataatcccgccagcctgaacgaggagaagctgctgctgctgatggcacagctcgaggccttgacccagcgcctgggcgagctgacccagcaggtggctcagctgcaggagcagacgcgggctgcggttgccacggtgaaatccaaataaaaaatgattcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgttgcacaatatctttgaggaggagactgatggccacgggcagccctttggtgtaggtgtttacaaatctgttaagctgggagggatgcatgcggggggagatgaggtgcatcttggcctggatcttgagattggcgatgttgccgcccagatcccgcctggggttcatgttgtgcaggaccaccagcacggtgtatccggtgcacttggggaatttatcatgcaacttggaagggaaggcgtgaaagaatttggcgacgcccttgtgcccgcccaggttttccatgcactcatccatgatgatggcgatgggcccgtgggcggcggcctgggcaaagacgtttcgggggtcggacacatcatagttgtggtcctgggtgagatcatcataggccattttaatgaatttggggcggagggtgcccgattgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttgcggagcagctgtgacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacaagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccagccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagagcagcttggcgatggagcgcatggtctggttcttttccttgtcggcgcgctccttggcggcgatgttgagctgcacgtactcgcgcgccacgcacttccattcggggaatacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagatcgtccagacttgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgtgccgagattggagcgctgcggcttttcggcgcggtagacgatctggcggaagatggcgtgggagttggaggagatggtgggcctctggaagatgttgaagtgggcgtggggcagtccgaccgagtccctgatgaagtgggcgtaggagtcctgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagggcccagtcggcgacgtgggggttggcgcggaggaaggaagtccagagatccacagccagggcggtctgcaagcggtcccggtactgacggaactgctggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctggtgctgtactacgtcctggccatcggcgtggccatcgtctgcctcgatggtggtcatgctgacgagcccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtgccgtgcccctggggcgccaccaccgtgccccgtttcttcttgggcgctggcggcgttggcgctggttccatgtcggtcagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcnaggttgagctcnacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtanaagtccacggcgaagttgaaaaactgggagttgcgcgccgagacggtcaactcctcctccagaagacggatgagctcggcgatggtggcgcgcacctcgcgctcgaaggccccggggggctcctcttcttccatctcctcctcctcttcctcctccactaacatctcttctacttcctcctcaggaggcggcggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcacggtttcttctggcgggtcatgttggttggagggagcggggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctgcggctggacgagcgccaggtcggcgacgacgcgctcggcgaggatggcctgctggatctgggtgagggtggtctggaagtcgtcnaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgctaacgaaacctccaggatacggaggcgggtcgttttttggccttggccgctggtcatgaaaaactagtaagcgcggaaagcggccgtccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttcttgtgtttttgccagatgcatcccgtactgcggcagatgcgcccccaccctccaccacaaccgcccctaccgccgcagcagcagcaacagccggcgcttctgcccccgccccagcagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaagcggcggcaggaccctacgtagaagaggtggacgatgaggtggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccctggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggcgttcaagaacttgcagggattgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccattggccaggcgcacgtggacgagcagacctaccaggagatcacccacgtgagccgcgccctgggccaggacgacccgggcaatctggaagccaccctgaacttcttgctgaccaaccggtcgcagaagatcccgccccagtacgcgctcagcgccgaggaggagcgcatcctgcgatacgtgcagcagagcgtgggcctgttcctgatgcaggagggggccacccccagcgccgcgctcgacatgaccgcgcgcaacatggagcccagcatgtacgccagcaaccgcccgttcatcaataagctgatggactacttgcatcgggcggccgccatgaactctgactatttcaccaatgctattttgaacccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgctcgtcctcggcgctgtccggccgcgagggtgctgccgcggcggtgcccgaggccgccagtccgttcccgagcttgcccttctcgctgaacagcattcgcagcagcgagctgggcaggatcacgcgcccgcgcttgctgggcgaggaggagtacttgaatgactcgctgttgagacccgagcgggagaagaacttccccaataacgggatagagagcctggtggacaagatgagccgctggaagacgtatgcgcaggagcacagggacgatccccgggcgtcgcagggggccacgagccggggcagcgccgcccgtaaacgccggtggcacgacaggcagcggggactgatgtgggacgatgaggattccgccgacgacagcagcgtgttggacttgggtgggagtggtggtggtaacccgttcgctcacctgcgcccccgcatcgggcgcatgatgtaagaaaccgaaaataaatggtactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagaccccaaacggggtgacagtagatgagaattatgatggtagtcaggatatcttggagtatgagtgggtggagtttgagctgcccgaaggcaacttctcggtgaccatgaccatcgacctgatgaacaacgccatcatcgacaattacttggcggtagggcggcagaacggggtgctggagagcgacatcggcgtgaagttcgacactaggaacttcaggctcggttgggaccccgtgaccgagctggtcatgcccggggtgtacaccaacgaggccttccaccccgatattgtcttgctgcccggctgcggggtggacttcaccgagagccgcctcagcaacctgctgggcattcgcaagaggcagcccttccaggagggtttccagatcatgtacgaggatctggaggggggcaacatccccgcactcctggatgtcgacgcctacgaggaaagcaaggaaaaagcagaagccgaggcgaccgcagccgtgactaccgccgcgaccaccaatgcagatgcaactaccaccagaggcgatacattcgccactcaggcggaggaagcagccgccctagcggtcgccgatgatagcgaaagtaagatagtcattcagccagtgaagaaggatagcaagaacagaagttacaacgtgctgccggacgaggtaaacaccgcctaccgcagctggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacncccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggcggtgaaggaggaaagaaagccccgcaaaatcaagcgggtcaaaaaggacaaaaaggaagaagatgacgatctggtggagtttgtgcgcgagttcgccccccggcggcgcgtgcagtggcgcgggcggaaagtgcgtccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgctccgcgccgaaggaagaggcggtgtccatcccgctggaccacggcaaccccacgccgagcctcaagcccgtgaccctgcagcaggtgctgccgagcgcggcgccgcgaagggggttcaagcgcgagggcgaggatctgtaccccaccatgcagctgatggtgcccaaacgccagaagctggaagacgtgctggaaaccatgaaggtggacccggacgtgcagcccgaggtcaaggtgcggcccatcaagcaggtggccccgggtctgggcgtgcagaccgtggacatcaagatccccacggagcccatggaaacgcagaccgagcccatgatcaagcccagtaccagcaccatggaggtgcagacggatccctggatgccggctgcccccaccaccagcagccgaagaccccggcgcaagtacggcgcggccagcctgctgatgcccaactacgcgctgcatccttccatcatccccacgccgggctaccgcggcacgcgcttctaccgcggtcatacaaccagctcccgccgccgcaagaccaccactcgccgccgccgtcgccgcaccgccgctgcatctacccccgccgccctggtgcggagagtgtaccgccgcggccgcgcgcctctgaccctgccgcgcgcgcgctaccacccgagcatcgccatttaaaactttcgcctgctttgcagatggccctcacatgccgcctccgcgttcccattacgggctaccgaggaagaaaaccgcgccgtagaaggctggcggggaacgggatgcgtcgccaccaccatcggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgaaaagcgaccccgccccgacgcggaggaaacgctgctgacgcacacggacgagccgcccccgtacgaggaggcggtgaaactgggtctgcccaccacgcggcccatcgcgcccctggccaccggggtgctgaaacccgaaactaagcccgcgaccctggacttgcctcctcccgcttcccgtccctccacagtggctaagcccctgccgccggtggccgtggcccgcgcgcgacccgggggctccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaatgctctggctcctaaagctgctcctaatcctagtcagtggaatgaaaccactgagggaacgaatggaaatgctgatgccactactactaaacatagttttggattggctgccatgaagggtgataatatcgcggctgaagggctgcagataggaacagattctacctctggaaccgatacacctatctatgcagataagctgtatcagccagagcctcagataggagaggaatcatggacagataacgatggaaccaatgaaaaatttggaggaagagttcttaagcccgataccaacatgaaaccctgctatgggtcctttgccaagcccactaataacaaaggtggtcaagcaaaacaaaaggcaacagaaggaacagctgtggattatgatgttgacatgaactttttcgatggtagagatgcagctgctaactttactccagaagtagtgttgtatgctgaaaatgtggatttggagactccagatacccatattgtatacaaaccaggaacttcagatctgagttcccatgtaaatttgggtcaacaggccatgcccaacagacccaactacatcggcttcagagacaactttatcggcctcatgtactacaacagcactggcaatatgggggtgctggctggtcaggcctcccagctgaatgctgtggttgacttgcaagacagaaacaccgagctgtcataccagctcttgcttgactctctgggtgacagaacccggtatttcagcatgtggaaccaggcggtggacagttatgaccccgatgtgcgcattattgaaaaccatggtatagaagatgaacttcccaactactgtttcccaattgatgctgtgggcattaccagaacctatcaaggcataaaagtacaaaatggaactggcactggaacgacatgggaaaaagatactgatgttagtacagcaaatgaaataggcattggcaacaatcttgccatggaaatcaacatccaagccaacctgtggaggaacttcctttactcgaacgtggctctgtacctgcccgattcttacaagtacacaccggccaacgtcaccctgcccaccaacaccaacacctacgattacatgaacggccgggtggtggcaccttcgctggtggacgcctacatcaacatcggggcgcgctggtcgctggaccccatggacaacgtcaatcccttcaaccaccaccgcaacgcgggcttgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcttccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggaaacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccaggggcagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcgtcttgctacttgcatgatggctgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttactgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaaaccgtgtgtgtatgtgaatgctttattcataataaacagcacatgtttatgccaccttctctgaggctctgactttatttagaaatcgaaggggttctgccggctctcggcgtgccccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcacagttgggacccgcgttctgcgcgcgagagttgcggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgttcggagctcatgcccgggtacatggccttcatgaaagcctccagctggcggaaggcctgctgcgccttgccgccctcggtgaagaagaccccgcaggacttgctagagaactggttggtggcgcagcccgcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcgtgtgctccttctggatcatcacggtcccgtgcaggcaccgcagcttgccctcggcctcggtgcagccgtgcagccacagcgcgcagccggtgctctcccagttcttgtgggcgatctgggagtgcgagtgcacgaagccctgcaggaagcggcccatcatcgcggtcagggtcttgttgctggtgaaggtcagcgggatgccgcggtgctcctcgttcacatacatgtggcagatgcggcggtacacctcgccctgctcgggcatcagctggaaggcggacttcaggtcgctctccacgcggtaccgttccatcagcagcgtcatgacttccatgcccttctcccaggccgaaacgatcggcaggctcagggggttcttcaccgccattgtcatcttagtcgccgccgccgaggtcagggggtcgttctcgtccagggtctcaaacactcgcttgccgtccttctcggtgatgcgcacgggggggaaggcgaagcccacggccgccagctcctcctcggcctgcctttcgtcctcgctgtcctggctgatgtcttgcaaaggcacatgcttggtcttgcggggtttctttttgggcggcagaggcggcggcgatgtgctgggcgagcgcgagttctcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaagcatggagactcagccatcgtcgccaacatcgccatctgcccccgccgccaccgccgacgagaaccagcagcagcagaatgaaagcttaaccgccccgccgcccagccccacctccgacgccgcggccccagacatgcaagagatggaggaatccatcgagattgacctgggctacgtgacgcccgcggagcacgaggaggagctggcagcgcgcttttcagccccggaagaaaaccaccaagagcagccagagcaggaagcagagagcgagcagaaccaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccacgcgtgccccccaagcgccagcccaacggcacctgcgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcacctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggaacgagtagcaccccccagagtctggaagagcggcgcaagctcatgatggccgtggtcctggtgaccgtggagcttgagtgtctgcgccgcttctttgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcaaaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgtaccaccgcctcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacctgctgcgcctggccaactacctggcctaccactcggacgtgatcgaggacgtcagcggcgagggtctgctcgagtgccactgccgctgcaacctctgcacgccgcaccgctccctggcctgcaacccccagctgctgagcgagacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccggaggatttggaggaagactgggagagcagtcaggcagaggagatggaagactgggacagcactcaggcagaggaggacagcctgcaagacagtctggaggaggaagacgaggtggaggaggaggcagaggaagaagcagccgccgccagaccgtcgtcctcggcggaggagaaagcaagcagcacggataccatctccgctccgggtcggggtcccgctcggccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaacttcccccgcaacatcttgcattactaccgtcacctccacagcccctactacttccaagaagaggcagcagaaaaagaccagaaaaccagctagaaaatccacagcggcggcagcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcaccacctgcgcccttcgcccgaccatcatcatgagcaaagagattcccacgccttacatgtggagctaccagccccagatgggcctggccgccggcgccgcccaggactactccacacgcatgaattggctcagcgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggatctcgccgagttcacctactttgagctgcccgaggagcaccctcagggcccggcccacggagtgcggatcgtcgtcgaagggggtctcgactcccacctgcttcggatcttcagccagcgaccgatcctggtcgagcgccaacagggcaacaccctcctgaccctctactgcatctgcgaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcgcgacctttcctctgaatctaataccactaccggaggtgagctccgaggtcgaccaacctctgggatttactacggcccctgggaggtggtggggttaatagcgctaggcctagttgtgggtgggcttttggctctctgctacctatacctcccttgcttttcctacttagtggtgctttgttgctggtttaagaaatggggaagatcaccctagtgtgcggtgtgctggtgacggtggtgctttcgattctgggagggggaagcgcggctgtagtgacggagaaggccgatccctgcttgactttcaaccccgataaatgccggctgagttttcagcccgaaggcaatcggtgcatagtgctgatcaagtgcggatgggaatgcaaggatgtgaaaatccagcacaataacaagacgcggaacaatactctcgcgtccacatggcagcccggggaccccgagtggtacaccgtctctgtccctggtgctgacggctccctccgcacggtaaacaacactttcatttttgagcacatgtgcgataccgccatgttcatgagcaagcagtacggtatgtggcccccgcgaaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacacacttttttcacacaccttgtttttttacagacaatgcgtctgttaatttttgttatcattacactcagctttaactatgcccatggctatgcaaatatacaaaaaaccctctatgtaggctctgactctacattagaaggtactcaatctcaagccagggtttcatggtatttttataaaggctctgatgccccaattactctttgcaaaggtgatcatgggcgcgcaacaaagccacctatcacatttagctgcaccagaacaaacctcacgcttttatccattacaaaagaatatgctggcacttattacagcacaaattttcatagtgggcaagataaatattatactgttaaggtagaaaaccctaccacccctagaacaactacaaagcccaccacaactaagaagcccactacacctaagaagcctaccacgcccaaaaccactaagaccactaccacagagccgaccacaaccagcaccacacttgctataactacacacactgagctgacctcacaggcaactactgaaaatgatatggttgccctgttgcagaagggggaaaatagtagcagcagtcctctgcctactacccccagtgaggaaatacctaagtctatggttggcattatcgctgctgtagtggtgtgtatggtgattatcatcttgtgcatgatgtactatgcctgctactacagaaaacacaggctaaacaacaagctggaccccttactgagtgttgatttttaattttttagaaccatgaagatcctaagcctttttttgttttctataattattacctctgctctatgcaattccaacgatgacgttactgttgttgttggatcaaattatacactgaaaggacctccaaagggtatgctttcgtggtattgctggtttggaactgatgacaaacaaacagagctctgcaatcttaaaaatggaaaagtctcaaacccaaaaatctccaattatatatgcaatggcactgatttaattctgctcaatatcacgaaagcatatgctggcagttacacctgccctggagacgacactgaaaatatgatttttaaaaaattaattgtagttgaccctactactccagcaccacccaccacaacaactaccaaggcacataccacacacaaacaaactacaccagaggcagaagcagagttagcaaagcagattcaagaagattcctttgttgccaatacccccacacaccccggaccgcaatgtccagggccattagtcagcggcattgtcggtgtgctttgcgggttagcagttataatcatctgcatgttcatttttgcttgctgctacagaaggcttcaccgacaaaaatcagacccactgctgaacctctatgtttaattttttccagagccatgaaggcagttagcgctctagttttttgttctttgattggcattgtttttagtgctgggtttttgaaaaatcttaccatttatgaaggtgagaatgccactctagtgggcatcagtggtcaaaatgtcagctggctaaaataccatctagatgggtggaaagacatttgcgattggaatgtcactgtgtatacatgtaatggagttaacctcaccattactaatgccacccaagatcagaatggtaggtttaagggccagagtttcactagaaataatgggtatgaatcccataacatgtttatctatgacgtcactgtcatcagaaacgagactgccaccacacagatgcccactacacacagttctaccactactagcatgcaaaccacacagacaaccactttttatacatcaactcagcatatcaccactacagcagcaaagccaagtagcgcagcgcctcagccacaggctttggctttgaaagctgcacaacctagtacaactactaggaccaatgagcagactactgattttttgtccactgtcgagagccacaccacagctacctcgagtgccttctctagcaccgccaatctctcctcgctttcctctacaccaatcagtcccgctactactcctacccccgctcctcttcccactcccctgaagcaaacagacggcggcatgcaatggcagatcaccctgctcattgtgatcgggttggtcatcctggccgtattgctctactacatcttctgccgccgcattcccaacgcgcaccgcaagccggtctacaagcccatcgttgtcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcgtcacctgcatctgctgctgtagcatagtctgcctgcttatcaccttcttccagttcattgactggatctttgtgcgcatcgcctacctgcgccaccacccccagtaccgcgaccagcgagtggcgcagctgctcaggctcctctgataagcatgcgggctctgctacttctcgcgcttctgctgttagtgctcccccgtcccgtcgacccccggtcccccactcagtcccccgaggaggttcgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcagcaacctcaggcacacgcactaccaccaccacagcctaggccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgccagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcaacgccagaagttcacctgcctggtcggagtcaaccccatcgtcatcacccagcagtctggcgataccaagggttgcatccactgctcctgcgactcccccgagtgcgttcacaccatgatcaagaccctctgcggcctccgcgacctcctccccatgaactaatcaactaacccctaccccatttacccagatacaataaagattaaagagatgatgatttgaattgatcaataaagaatcacttacttgaaatctgaaaccaggtctctgtccatgttttctgtcagcagcacttcactcccctcttcccagctctggtactgcagaccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaacggggctgtcaccctcaagctgggggagggagtgggcctcgactcctcgggaaaactcatatctaccactgccaccactaaagctacagcccccctcagtatttccaacaacaccatttcccttaacatggatacccctttctataccaaaaatggaaacttagctctaaacatagccgcaccgctcagagtagcagatatattaaacacattggttgtagcatatggtcaaggtttaggtttaaacaataatgcccttgctgttcaagttacatctccacttacttttgatggcaataacaggcttaagataaatttagctaatggcccactaaaggttgaagcaagcagactgtccatcaagtgccagagaggaatatatgtcaccactactggagaagcaattgaaaccaatataagctggccaagaggtattagatttgaaggcaatgctatggctgtgaacattgacaccaacaaaggcttacaatttggaactaccagtacagaaacaggagttaacaatgcttacccaattcaagttaagctaggagctggtcttagttttgacagcacaggagctattgttgcatgggacaaagcagatgacaaactcacgttgtggactactccagacccaagtccaaattgcaaaatagcatctgacaaagatgctaagcttacactttgcttgacaaaatgcggcagccaaattttaggtaccgtctccctgttagctgtcagtggcagcctagctccaattacaggagttgttaacactgcacttgtatcacttaaattcaatgccagtggagcacttttggataaatcaacacttaacaaagaatattggaattatagacaaggagatcttattccaggtactccatacactaatgccataggctttatgcctaacttaaaggcatatccaaaaaacacaagtggagcttccaaaagccacattgtaggagaagtctatctggatggggaagcagataagcctttatctcttacaatcacttttaatgaaactgatgatgaaacctgtaactattgtatcaactttcaatggaaatgggaggctgatcaatacaaagaaaagaccctcgcaaccagctcattcaccttctcctacattgcccaagaataagccgcccaactctgttacccaccctgcatgcataaccctctgtatcccacaccccctttctatggaaaactctgaagcagaaaataaagttcaagtattctttattggaatcagttatttcttttacaggatacgagtagtgattttccctccaccttcccatttcatcgagtacaccatcctctccccccgcacagccttaaacatctgtatgccattagagatggacatggttttggtctccacattccacacagtttcagagcgagccagtctcggatcggtaatggaaataaaaccctcctgacagtcctgcatagccgcctcacagtccaacagttgagggctctcctcggtggtcgggatcacagttatctggaagaagaagaacggtgggaatcataatcctggaacgggatcggccggttgtgaagcatcaaaccccggagcagtctctgtctcctgcgctccgtgcggctgctgctaatggggtccgggtccaaggactccctcagcatgaggcccacggccctcagcatcaaccgcctggtgcggcgggcgcagcagcgcatacggatctcgctcagctcggagcagtaagtgcagcacatgatcaccaggttgttcaacaaaccatagttcagagtgctccagccaaagctcatagccggcacaatgctgcccacgtgcccgtcgtaccagatcctgatgtaaatcaggtggcgacctctccaaaacacactgcccacgtacatgatctccttgggcatgtgcaggttcactacctcccggtaccacaccactcgctggttgaacatgcagccctggatgatcctgcggaaccagatggccagcaccgctccgccggccatgcaccgaaggcagccggggtcgttacagtggcagtggatcatccaccgctcgcggccgtggatcacctgggagctgaacacgtctatggtggcacagcacaggcacacgctcatgcaattccgcatcactctgagctcctccggggtaagaaccatgtcccagggtacggggaactcttgtaagacagtaaagcccgcagaacaaggcagccctcgcacacaacttacattgtgcatgctcaaggtatcgcaatcaggcagcaaggggtgatcctccaccagagaagcgcgggtctcggtctcctcacagcgtggtaagtggaccggttggtacgggtgatggcgggatgaggctaatcgtgttcgagatcgtgtcatgatgcagtctctttcggacgtcctcgtactttgcatagcagaacctggtgcgggcgctgcacactgccttccggcggcggtcgcggcgcttggaacgctcggtattccagttatagaacagccactctctcaggtggttcaacacctcctgagcctcctgggtgacaaagatcccgtcagctctgatggctctgatgatctcgacaacggtggtgtgggcccaccccagccagatgatacagttctgctgggtttcaacaacgttggggggaggaaggacaggaagaaccatggttaactttattccaaacggtcgcggagcacttcaaaacggaggtcgcgaagatggcacctctcgcccccgctgtgttggtggaaaacaacagccaggtcaaacacgacacggttttccaggtgctcgacggtggcttccagcaaagcctccacgcgcacgtccagaaacaaaaggatagcgaaagcgggagcgttttctaattcctcaatcatcatattacattcctgcaccatccccagataattttcatttttccaggtctgaatgattcgaactaattcctgaggtaagtccaagccagccattataaaaagctctcggagagcgccctccaccggcatcctcaagcacaccctcatagttgcaagagatcctgctcctctgacacctgcagcagattaagaatggcaatatcaaagtttctgccgcggaacctaagctcttccctcagcgataactgtaagtactgcttcatgtcctctctaaagtttttaaccacaggcccaccaggaatgagagaaggagaagccacagcacagttaaaccgaagtcctccccagtgagcaccagcaaatgtaagattgcaataagcatagtgagtgggagcggtgatatcgtccaaattgctggacagaaaatcgggcaggtattctctcaaaaaatcaataaaagaaaaatcctccaaatgcaggttcagagcttcggggacaatgatggaaagagtcactgagctgcgctcgaacatagctaggccttttgtttttttaaatctgtaaaaaataaaaaaagaaaatattaaaccatgctagcctgacgcacaggcgggaaaatcactctttccagcaccaggcagcccactgggtcgccggcgcggccctcgtaaaaattatcagtatgattgaaaatcatcaccgaaagctcttgtctatggcctgcatgaatgattcgagtggaggtgtagaccccggcagcgctaggatcggtcagagagaaaaagcgcccctgatagcccctcggaagctgtatgctcagcctcaaatacagcaaagcgaccccgtgcggttgcagtacgaaattctcaggagagtaaaaaatgtaattattcgactcctgaacaggcagcacagccccaggcccctccaaaaagacatataaagcgtcgccctccatcatagcttaccaagcacaacagccgcaacaggcacaagagtcagagaaaggctgagctctaaactgactacccgctctgctcaatatatagagatctgtacactgacgtaaaggccaaagtctaaaaatacccgccaaaagtcacacacgcccaacacacgccccgaaaccggtgacacactcagaaaaatacgcgcacttcctcaaacgcccaaaaacccgtcacttcccggttcccacgctacgtcatctccaggcgctttcaaaatccgtcgaccgttagtgacgtcaaaatcttgtaacggtccgaattcgaaaaacgtcacttccgctcctccagccccgcccctaacggtcgccggtcccagcggccaatcacngcctcgaattcccaaattcaaacgcctcatttgcatattaacgcgcaccaaaagtttaaggnatattattgatgatg

SEQ ID NO: 140 - protein, 193 aa, Unknown
  Synthetic Construct
MEIWTVLEDFHQTRQLLENSSEEVSYLWRFCFGGALAKLVYRAKHDYKDQFEDILRECPGIFDSLNLGHQSHFNQSILRALDFSTPGRTTAAVAFFAFILDKWSQETHFSRDYRLDCLAVALWRTWRCQRLNAISGYLPVQPVDTLRILSLQSPQEHQRRQQPQQEQQQEEEEEDREENPRAGLDPPVAEEEE

SEQ ID NO: 141 - protein, 142 aa, Unknown; identical to SEQ ID NO: 3
  Synthetic Construct

SEQ ID NO: 142 - protein, 393 aa, Unknown
  Synthetic Construct
MHPVLRQMRPHPPPQPPLPPQQQQQPALLPPPQQQQQPATTAAAAVSGAGVQYDLALEEGEGLARLGASSPERHPRVQMKRDAREAYVPKQNLFRDRSGEEPEEMRAARFHAGRELRRGLDRKRVLRDEDFEADELTGISPARAHVAAANLVTAYEQTVKEESNFQKSFNNHVRTLIAREEVTLGLMHLWDLLEAIVQNPTSKPLTAQLFLVVQHSRDNEAFREALLNITEPEGRWLLDLVNILQSIVVQERGLPLSEKLAAINFSVLSLGKYYARKIYKTPYVPIDKEVKIDGFYMRMTLKVLTLSDDLGVYRNDRMHRAVSASRRRELSDQELMHSLQRALTGAGTEGESYFDMGADLHWQPSRRALEAAAGPYVEEVDDEVDEEGEYLED

SEQ ID NO: 143 - protein, 593 aa, Unknown
  Synthetic Construct
MQQQPPPDPAMRAALQSQPSGINSSDDWTQAMQRIMALTTRNPEAFRQQPQANRLSAILEAVVPSRSNPTHEKVLAIVNALVENKAIRGDEAGLVYNALLERVARYNSTNVQTNLDRMVTDVREAVAQRERFHRESNLGSLVALNAFLSTQPANVPRGQEDYTNFISALRLMVTEVPQSEVYQSGPDYFFQTSRQGLQTVNLSQAFKNLQGLWGVQAPVGDRATVSSLLTPNSRLLLLLVAPFTDSGSINRNSYLGYLINLYREAIGQAHVDEQTYQEITHVSRALGQDDPGNLEATLNFLLTNRSQKIPPQYALSAEEERILRYVQQSVGLFLMQEGATPSAALDMTARNMEPSMYASNRPFINKLMDYLHRAAAMNSDYFTNAILNPHWLPPPGFYTGEYDMPDPNDGFLWDDVDSSVFSPRPGANERPLWKKEGSDRRSSSALSGREGAAAAVPEAASPFPSLPFSLNSIRSSELGRITRPRLLGEEEYLNDSLLRPEREKNFPNNGIESLVDKMSRWKTYAQEHRDDPRASQGATSRGSAARKRRWHDRQRGLMWDDEDSADDSSVLDLGGSGGGNPFAHLRPRIGRMM

SEQ ID NO: 144 - protein, 542 aa, Unknown
  Synthetic Construct
MMRRAYPEGPPPSYESVMQQAMAAAAMQPPLEAPYVPPRYLAPTEGRNSIRYSELAPLYDTTRLYLVDNKSADIASLNYQNDHSNFLTTVVQNNDFTPTEASTQTINFDERSRWGGQLKTIMHTNMPNVNEFMYSNKFKARVMVSRKTPNGVTVDENYDGSQDILEYEWVEFELPEGNFSVTMTIDLMNNAIIDNYLAVGRQNGVLESDIGVKFDTRNFRLGWDPVTELVMPGVYTNEAFHPDIVLLPGCGVDFTESRLSNLLGIRKRQPFQEGFQIMYEDLEGGNIPALLDVDAYEESKEKAEAEATAAVTTAATTNADATTTRGDTFATQAEEAAALAVADDSESKIVIQPVKKDSKNRSYNVLPDEVNTAYRSWYLAYNYGDPEKGVRSWTLLTTSDVTCGVEQVYWSLPDMMQDPVTFRSTRQVSNYPVVGAELLPVYSKSFFNEQAVYSQQLRAFTSLTHVFNRFPENQILVRPPAPTITTVSENVPALTDHGTLPLRSSIRGVQRVTVTDARRRTCPYVYKALGIVAPRVLSSRTF

SEQ ID NO: 145 - protein, 193 aa, Unknown; identical to SEQ ID NO: 6
  Synthetic Construct

SEQ ID NO: 146 - protein, 345 aa, Unknown
  Synthetic Construct
MSKRKFKEEMLQVIAPEIYGPAAAVKEERKPRKIKRVKKDKKEEDDDLVEFVREFAPRRRVQWRGRKVRPVLRPGTTVVFTPGERSGTASKRSYDEVYGDDDILEQAAERLGEFAYGKRSRSAPKEEAVSIPLDHGNPTPSLKPVTLQQVLPSAAPRRGFKREGEDLYPTMQLMVPKRQKLEDVLETMKVDPDVQPEVKVRPIKQVAPGLGVQTVDIKIPTEPMETQTEPMIKPSTSTMEVQTDPWMPAAPTTSSRRPRRKYGAASLLMPNYALHPSIIPTPGYRGTRFYRGHTTSSRRRKTTTRRRRRRTAAASTPAALVRRVYRRGRAPLTLPRARYHPSIAI

SEQ ID NO: 147 - protein, 77 aa, Unknown; identical to SEQ ID NO: 65
  Synthetic Construct

SEQ ID NO: 148 - protein, 257 aa, Unknown
  Synthetic Construct
MDSDAPGPVMCFRRQMEDINFSSLAPRHGTRPFMGTWSDIGTSQLNGGAFNWSSLWSGLKNFGSTLKTYGSKAWNSTTGQALREKLKEQNFQQKVVDGLASGINGVVDLANQAVQRQINSRLDPVPPAGSVEMPQVEEELPPLDKRGEKRPRPDAEETLLTHTDEPPPYEEAVKLGLPTTRPIAPLATGVLKPETKPATLDLPPPASRPSTVAKPLPPVAVARARPGGSARPHANWQSTLNSIVGLGVQSVKRRRCY

SEQ ID NO: 149 - protein, 941 aa, Unknown
  Synthetic Construct
MATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNALAPKAAPNPSQWNETTEGTNGNADATTTKHSFGLAAMKGDNIAAEGLQIGTDSTSGTDTPIYADKLYQPEPQIGEESWTDNDGTNEKFGGRVLKPDTNMKPCYGSFAKPTNNKGGQAKQKATEGTAVDYDVDMNFFDGRDAAANFTPEVVLYAENVDLETPDTHIVYKPGTSDLSSHVNLGQQAMPNRPNYIGFRDNFIGLMYYNSTGNMGVLAGQASQLNAVVDLQDRNTELSYQLLLDSLGDRTRYFSMWNQAVDSYDPDVRIIENHGIEDELPNYCFPIDAVGITRTYQGIKVQNGTGTGTTWEKDTDVSTANEIGIGNNLAMEINIQANLWRNFLYSNVALYLPDSYKYTPANVTLPTNTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 150 - protein, 209 aa, Unknown
  Synthetic Construct
MMAEPTGSGEQELRAIIRDLGCGPYFLGTFDKRFPGFMAPHKLACAIVNTAGRETGGEHWLAFAWNPRSNTCYLFDPFGFSDERLKQIYQFEYEGLLRRSALATEDRCVTLEKSTQTVQGPRSAACGLFCCMFLHAFVHWPDRPMDKNPTMNLLTGVPNGMLQSPQVEPTLRRNQEALYRFLNAHSAYFRSHRARIEKATAFDRMNQDM

SEQ ID NO: 151 - protein, 797 aa, Unknown
  Synthetic Construct
METQPSSPTSPSAPAATADENQQQQNESLTAPPPSPTSDAAAPDMQEMEESIEIDLGYVTPAEHEEELAARFSAPEENHQEQPEQEAESEQNQAGLEHGDYLSGAEDVLIKHLARQCIIVKDALLDRAEVPLSVAELSRAYERNLFSPRVPPKRQPNGTCEPNPRLNFYPVFAVPEALATYHLFFKNQRIPVSCRANRTRADALLNLGPGARLPDITSLEEVPKIFEGLGSDETRAANALQGSGEEHEHHSALVELEGDNARLAVLKRTVELTHFAYPALNLPPKVMSAVMDQVLIKRASPLSEEEMQDPESSDEGKPVVSDEQLARWLGTSSTPQSLEERRKLMMAVVLVTVELECLRRFFADAETLRKVEENLHYLFRHGFVRQACKISNVELTNLVSYMGILHENRLGQNVLHTTLRGEARRDYIRDCVYLYLCHTWQTGMGVWQQCLEEQNLKELCKLLQKNLKALWTGFDERTTASDLADLIFPERLRLTLRNGLPDFMSQSMLQNFRSFILERSGILPATCSALPSDFVPLTFRECPPPLWSHCYLLRLANYLAYHSDVIEDVSGEGLLECHCRCNLCTPHRSLACNPQLLSETQIIGTFELQGPGEGKGGLKLTPGLWTSAYLRKFVPEDYHPFEIRFYEDQSQPPKAELSACVITQGAILAQLQAIQKSRQEFLLKKGHGVYLDPQTGEELNPSFPQDAPRKQQEAESGAAAGGFGGRLGEQSGRGDGRLGQHSGRGGQPARQSGGGRRGGGGGRGRSSRRQTVVLGGGESKQHGYHLRSGSGSRSAPQ

SEQ ID NO: 152 - protein, 227 aa, Unknown
  Synthetic Construct
MSKEIPTPYMWSYQPQMGLAAGAAQDYSTRMNWLSAGPAMISRVNDIRAHRNQILLEQSAITATPRHHLNPRNWPAALVYQEIPQPTTVLLPRDAQAEVQLTNSGVQLAGGATLCRHRPAQGIKRLVIRGRGTQLNDEVVSSSLGLRPDGVFQLAGSGRSSFTPRQAVLTLESSSSQPRSGGIGTLQFVEEFTPSVYFNPFSGSPGHYPDEFIPNFDAISESVDGYD

SEQ ID NO: 153 - protein, 106 aa, Unknown; identical to SEQ ID NO: 71
  Synthetic Construct

SEQ ID NO: 154 - protein, 175 aa, Unknown
  Synthetic Construct
MGKITLVCGVLVTVVLSILGGGSAAVVTEKADPCLTFNPDKCRLSFQPEGNRCIVLIKCGWECKDVKIQHNNKTRNNTLASTWQPGDPEWYTVSVPGADGSLRTVNNTFIFEHMCDTAMFMSKQYGMWPPRKENIVVFSIAYSACTVLITAIVCLSIHMLIAIRPRNNAEKEKQP

SEQ ID NO: 155 - protein, 240 aa, Unknown
  Synthetic Construct
MRLLIFVIITLSFNYAHGYANIQKTLYVGSDSTLEGTQSQARVSWYFYKGSDAPITLCKGDHGRATKPPITFSCTRTNLTLLSITKEYAGTYYSTNFHSGQDKYYTVKVENPTTPRTTTKPTTTKKPTTPKKPTTPKTTKTTTTEPTTTSTTLAITTHTELTSQATTENDMVALLQKGENSSSSPLPTTPSEEIPKSMVGIIAAVVVCMVIIILCMMYYACYYRKHRLNNKLDPLLSVDF

SEQ ID NO: 156 - protein, 207 aa, Unknown
  Synthetic Construct
MKILSLFLFSIIITSALCNSNDDVTVVVGSNYTLKGPPKGMLSWYCWFGTDDKQTELCNLKNGKVSNPKISNYICNGTDLILLNITKAYAGSYTCPGDDTENMIFKKLIVVDPTTPAPPTTTTTKAHTTHKQTTPEAEAELAKQIQEDSFVANTPTHPGPQCPGPLVSGIVGVLCGLAVIIICMFIFACCYRRLHRQKSDPLLNLYV

SEQ ID NO: 157 - protein, 91 aa, Unknown
  Synthetic Construct
MIPRQFLITILICLLQVCATLALVANASPDCIGPFASYVLFAFVTCICCCSIVCLLITFFQFIDWIFVRIAYLRHHPQYRDQRVAQLLRLL

SEQ ID NO: 158 - protein, 144 aa, Unknown
  Synthetic Construct
MRALLLLALLLLVLPRPVDPRSPTQSPEEVRKCKFQEPWKFLKCYRQKSDMHPSWIMIIGIVNILACTLISFVIYPCFDFGWNSPEALYLPPEPDTPPQQQPQAHALPPPQPRPQYMPILDYEAEPQRPMLPAISYFNLTGGDD

SEQ ID NO: 159 - protein, 442 aa, Unknown
  Synthetic Construct
MSKKRARVDDGFDPVYPYDADNAPTVPFINPPFVSSDGFQEKPLGVLSLRLADPVTTKNGAVTLKLGEGVGLDSSGKLISTTATTKATAPLSISNNTISLNMDTPFYTKNGNLALNIAAPLRVADILNTLVVAYGQGLGLNNNALAVQVTSPLTFDGNNRLKINLANGPLKVEASRLSIKCQRGIYVTTTGEAIETNISWPRGIRFEGNAMAVNIDTNKGLQFGTTSTETGVNNAYPIQVKLGAGLSFDSTGAIVAWDKADDKLTLWTTPDPSPNCKIASDKDAKLTLCLTKCGSQILGTVSLLAVSGSLAPITGVVNTALVSLKFNASGALLDKSTLNKEYWNYRQGDLIPGTPYTNAIGFMPNLKAYPKNTSGASKSHIVGEVYLDGEADKPLSLTITFNETDDETCNYCINFQWKWEADQYKEKTLATSSFTFSYIAQE

SEQ ID NO: 160 - DNA, 36770 bp, Unknown; identical to SEQ ID NO: 139
  Simian adenovirus A1322
  CDS (1910)..(3427): E1b\55K
  misc_feature (8962)..(8962): n is a, c, g, or t
  misc_feature (8974)..(8974): n is a, c, g, or t
  misc_feature (9130)..(9130): n is a, c, g, or t
  misc_feature (10003)..(10003): n is a, c, g, or t
  misc_feature (15785)..(15785): n is a, c, g, or t
  CDS (25625)..(26167): 22K
  CDS (27468)..(28088): E3\CR1-alpha
  CDS (29854)..(30891): E3\CR1-delta
  CDS (31610)..(32014): E3\14.7K
  misc_feature (36693)..(36693): n is a, c, g, or t
  misc_feature (36755)..(36755): n is a, c, g, or t

SEQ ID NO: 161 - protein, 505 aa, Unknown
  Synthetic Construct
MESRNPFQQGLPSGLLSSSFVENMEVPAPECNLRLLASTAGRHAEDPESPVTPGTPTPPAAAAGAAARGGGGGPRREPESRSGPSGGGGGGVADLFPELRRVLTRSSSGRERGIKRERHEETSHRTELTVSLMSRRRPESVWWHEVQSQGIDEVSVMHEKYSLEQVKTCWLEPEDDWEVAIRNYAKLALKPDKKYKITKLINIRNSCYISGNGAEVEISTQERVAFRCCMMNMYPGVVGMDGVTFMNMRFRGDGYNGTVFMANTKLTVHGCSFFGFNNTCIEAWGQVGVRGCSFSANWMGIVGRTKSVLSVKKCLFERCHLGVMSEGEARIRHCASTETGCFVLCKGNAKIKHNMICGASDERGYQMLTCAGGNSHMLATVHVASHARKPWPEFEHNVMTRCNMHLGSRRGMFMPYQCNLNYVKVLLEPDAMSRVSLTGVFDMNVDVWKILRYDESKTRCRACECGGKHARFQPVCVDVTEDLRPDHLVLSCTGTEFGSSGEESD

SEQ ID NO: 162 - protein, 180 aa, Unknown
  Synthetic Construct
MPRGSSKKLKVELPPEDLEEDWESSQAEEMEDWDSTQAEEDSLQDSLEEEDEVEEEAEEEAAAARPSSSAEEKASSTDTISAPGRGPARPHSRWDETGRFPNPTTQTGKKERQGYKSWRGHKNAIVSCLQACGGNISFTRRYLLFHRGVNFPRNILHYYRHLHSPYYFQEEAAEKDQKTS

SEQ ID NO: 163 - protein, 207 aa, Unknown
  Synthetic Construct
MKVFVVCCVLSIIKAEISDYSGLPCVPESINQSLFFTGNETELQLQCKPHKKYLTWLFQGSPIAVVNHCDNDGVLLSGPANLTFSTRRSKLQLFQPFLPGTYQCVSGPCHHTFHLIPNTTASLPATNNQTTHQRHRRDLSSESNTTTGGELRGRPTSGIYYGPWEVVGLIALGLVVGGLLALCYLYLPCFSYLVVLCCWFKKWGRSP

SEQ ID NO: 164 - protein, 346 aa, Unknown
  Synthetic Construct
MSRAISQRHCRCALRVSSYNHLHVHFCLLLQKASPTKIRPTAEPLCLIFSRAMKAVSALVFCSLIGIVFSAGFLKNLTIYEGENATLVGISGQNVSWLKYHLDGWKDICDWNVTVYTCNGVNLTITNATQDQNGRFKGQSFTRNNGYESHNMFIYDVTVIRNETATTQMPTTHSSTTTSMQTTQTTTFYTSTQHITTTAAKPSSAAPQPQALALKAAQPSTTTRTNEQTTDFLSTVESHTTATSSAFSSTANLSSLSSTPISPATTPTPAPLPTPLKQTDGGMQWQITLLIVIGLVILAVLLYYIFCRRIPNAHRKPVYKPIVVGQPEPLQVEGGLRNLLFSFTVW

SEQ ID NO: 165 - protein, 135 aa, Unknown
  Synthetic Construct
MTDPLANNNVNDLLLDMDGRASEQRLAQLRIRQQQERAVKELQDGIAIHQCKRGIFCLVKQAKISYEVTQTDHRLSYELLQQRQKFTCLVGVNPIVITQQSGDTKGCIHCSCDSPECVHTMIKTLCGLRDLLPMN

SEQ ID NO: 166 - DNA, 870 bp, Unknown
  Simian adenovirus A1322
  CDS (6)..(570): E1a
  CDS (664)..(869): E1a
gaaagatgaggcacctgagagacctgcccgatgagaaaatcatcatcgcttccgggaacgagattctggaactggtggtaaatgccatgatgggcgacgaccctccggagccccccaccccatttgagacaccttcgctacacgatttgtatgatctggaggtggatgtgcccgaggacgaccccaacgaggaggcggtaaatgatttatttagcgatgccgcactgctagctgccgaggaggcttcgagccctagctcagacagcgactcttcactgcatacccctagacccggcagaggtgagaaaaagatccccgagcttaaaggggaagagatggacttgcgctgctatgaggaatgcttgcccccgagcgatgatgaggacgagcaggcgatccagaacgtagcgagccagggagtgcaagccgccagcgagagctttgcgctggactgcccgcctctgcccggacacggctgtaagtcttgtgaatttcatcgcttgaatactggagataaagctgtgttatgtgcactttgctatatgagagcttacaaccattgtgtttacagtaagtgtgattaagttgaactttagagggaggcagagagcggggtgactgggcgatgactggtttatttatgtatatatgttctttatataggtcccgtctctgacgcagatgatgagacccccactacagagtccatttcgtcacccccagaaattggcacatctccacctgagaatattgttagaccagttcctgttagagccactgggaggagagcagctgtggaatgtttggatgacttgctacagggtggggatgaacctttggacttgtgtacccggaaacgccccaggcact

SEQ ID NO: 167 - protein, 257 aa, Unknown; identical to SEQ ID NO: 85
  Synthetic Construct

SEQ ID NO: 168 - DNA, 38568 bp, Artificial Sequence
  Simian adenovirus A1321 clone
  misc_feature (5)..(12): Swa\I
  repeat_region (16)..(144): ITR
  misc_feature (447)..(472): I-Ceu recognition site
  misc_feature (460)..(461): cleavage point for bottom strand
  misc_feature (464)..(465): cleavage point for top strand
  enhancer (814)..(1074): Enhancer
  misc_feature (1075)..(1302): CMV\promoter
  TATA_signal (1276)..(1279): TATA
  CDS (1398)..(2489): Gag\short
  polyA_signal (2642)..(2844): BGH-PolyA
  misc_feature (2917)..(2955): PI-Scel recognition sequence
  misc_feature (2927)..(2928): cleavage point on bottom strand
  misc_feature (2931)..(2932): cleavage point on top strand
  CDS (2956)..(3345): E1b\55K
  CDS (3433)..(3858): pIX
  misc_feature (3923)..(5544): IVa2    complement (3923..5253,5532..5544)
  misc_feature (8406)..(13786): pTP   complement (8406..10334,13778..13786)
  CDS (11974)..(13749): pIIIa
  CDS (13834)..(15453): penton
  CDS (15460)..(16038): pVII
  CDS (16083)..(17096): V
  CDS (17123)..(17353): pX
  CDS (17388)..(18149): pVI
  CDS (18258)..(21083): hexon
  CDS (21110)..(21730): protease
  misc_feature (21811)..(23340): DBP    complement (21811..23340)
  CDS (23369)..(25777): 100K
  CDS (26402)..(27082): pVIII
  CDS (27980)..(28507): E3\gp19K
  CDS (28540)..(29142): E3\CR1-beta
  CDS (29158)..(29772): E3\CR1-gamma
  CDS (30697)..(30969): E3\RID-alpha
  CDS (31402)..(31803): E3\14.7K
  CDS (32066)..(33400): fiber
  misc_feature (33499)..(34646): E4\orf6/7    complement (33499..33750,34473..34646)
  misc_feature (33750)..(34646): E4\orf6    complement (33750..34646)
  misc_feature (34739)..(35080): E4\orf4    complement (34739..35080)
  misc_feature (34929)..(35279): E4\orf3    complement (34929..35279)
  misc_feature (35279)..(35665): E4\orf2    complement (35279..35665)
  misc_feature (35718)..(36089): E4\orf1    complement (35718..36089)
  repeat_region (36367)..(36495): ITR   complement (36367..36495)
  misc_feature (36499)..(36506): Swa\I
  rep_origin (36744)..(36744): ORI
  misc_feature (37502)..(38365): AP(R)   complement (37502..38365)
aattatttaaatccccatcatcaataatatacctcaaacttttggtgcgcgttaatatgcaaatgagctgtttgaatttggggatggggcgttgtgattggacgagggatgagcgaccgttaggggcggggcgagtgacgttttgatgacgtggccgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatgacagggaggagtatttgccgagggccgagtagactttgaccgattacgtgggggtttcgattaccgtgtttttcacctaaatttccgcgtacgtaactataacggtcctaaggtagcgaaagctcagatctggatctcccgatcccctatggcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacagagagatgggtgcgagagcgtcagtattaagcgggggagaattagatcgatgggaaaaaattcggttaaggccagggggaaagaagaagtacaagctaaagcacatcgtatgggcaagcagggagctagaacgattcgcagttaatcctggcctgttagaaacatcagaaggctgtagacaaatactgggacagctacaaccatcccttcagacaggatcagaggagcttcgatcactatacaacacagtagcaaccctctattgtgtgcaccagcggatcgagatcaaggacaccaaggaagctttagacaagatagaggaagagcaaaacaagtccaagaagaaggcccagcaggcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaggacctgaacacgatgttgaacaccgtggggggacatcaagcagccatgcaaatgttaaaagagaccatcaatgaggaagctgcagattgggatagagtgcatccagtgcatgcagggcctattgcaccaggccagatgagagaaccaaggggaagtgacatagcaggaactactagtacccttcaggaacaaataggatggatgacaaataatccacctatcccagtaggagagatctacaagaggtggataatcctgggattgaacaagatcgtgaggatgtatagccctaccagcattctggacataagacaaggaccaaaggaaccctttagagactatgtagaccggttctataaaactctaagagctgagcaagcttcacaggaggtaaaaaattggatgacagaaaccttgttggtccaaaatgcgaacccagattgtaagaccatcctgaaggctctcggcccagcggctacactagaagaaatgatgacagcatgtcagggagtaggaggacccggccataaggcaagagttttgtagggatccactagttctagactcgagggggggcccggtacctttaagaccaatgacttacaaggcagctgtagatcttagccactttttaaaagaaaaggggggactggaagggctaattcactcccaaagaagacaagataaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcacatatgctggccaccgtgcatgtggcttcccattcccgcaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggatgtgacggaggacctgcgacccgatcatttggtgttgtcctgcaccgggacggagttcggttccagcggggaagaatctgactagagtgagtagtgttctggggcggtggagggcatgcatgagggccagaatgactgaaatctgtgcttttctgtgtgttgcagcagcatgagcggaagcggctcctttgagggaggggtattcagcccttatctgacggggcgtctcccttcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctattacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgcccgcccaggttttccatgcattcatccatgatgatggcgatgggcccgtgggcggcggcctgggcaaagacgtttcgggggtcggacacatcatagttgtggtcctgggtgagatcatcataggccattttaatgaatttggggcggagggtgccggactgggggacaaaggtaccctcgatcccgggggcgtagttcccctcacagatctgcatctcccaggctttgagctcggagggggggatcatgtccacctgcggggctataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgcttcaggctcatccggctggttgaaaaccgctcccgatcggcgccctgcgcgtcggccaggtagcaattgaccatgagttcgtagttgagcgcctcggccgcgtggcctttggcgcggagcttacctttggatgtctgcccacaggcgggacagaggagggacttgagggcgtagagcttgggggcaaggaagacggactcgggggcgtaggcatccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgaaacgaaagcccgggtccaggccagcacgaaggaggccacgtgggacgggtagcggtcgttgtccaccagcgggtccaccttctccagggtatgcaaacacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagtccctcgtccatctggtcagaaaagacgatctttttattgtcgagtttggtggcgaaggagccgtagagggcgttggaaaggagcttggcgatggagcgcatggtctggttcttttccttgtcggcgcgctccttggccgcgatgttgagttgcacgtactcgcgcgccacgcacttccattcggggaagacggtggtcagctcgtcgggcacgattctgacctgccagccccgattatgcagggtgatgaggtccacactggtggccacctcgccgcgcaggggttcattagtccagcagaggcgcccgcccttgcgcgagcagaaggggggcagggggtcgagcatgacctcgtcgggggggtcggcatcgatggtgaagatgccgggcaggaggtcgggatcaaagtagctgatagaagtggccagatcgtccagggaagcttgccattcgcgcacggccagcgcgcgctcgtagggactgaggggcatgccccagggcatggggtgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggtgcgaggagccccgggcccaggttggtgcggctgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgacgaggacgtccagagcgcagtagtcgagggtctcctggatgatgtcatacttgagctgacccttttgtttccacagctcgcggttgagaaggaactcttcgcggtccttccagtactcttcgagggggaacccgtcctgatcggcacggtaagagcctagcatgtagaactggttgacggccttgtaggcgcagcagcccttctccacggggagggcgtaggcctgggcggctttgcgcagggaggtgtgcgtgagggcgaaagtgtccctgaccatgactttgaggaactggtgcttgaagtcgatatcgtcgcagcccccctgctcccagagttggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaaccgtgggcggcccttgacgtggggcagcttcttgagctcttcgtaggtgagctcgtcggggtcgctgagcccgtgctgctcgagcgcccagtcggcgagatgggggttggcgcggaggaaagaagtccagagatccacggccagggcggtttgcaggcggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcagcccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcggctggggcgacgggggcggtgtttccatctcggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaagcgttccatggcctcgtaaaagtccacggcgaagttgaaaaactgggagttacgcgccgagacggtcaactcctcctccagaagacggatgagctcggcgatggtggcgcgcacctcgcgctcgaaggcccccgggagttcctcctcttccatctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctgccgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaactttttggaggccggaaatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcagcagcaacttccagccacgaccgccgcggccgccgtgagcgggactggacagacttctcagtatgaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggacagaaagagggtgctgagggacgaggatttcgaggcggacgagctgacggggatcagccccgcgcgtgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcaacatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccctggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggcgttcaagaacttgcagggcctctggggcgtgcaggccccggtcggggaccgcgcgacggtgtcgagcctgctgacgccgaactcgcgcctgctgttgctgctggtggctcccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggaaatctggaagccaccctgaactttttgctgaccaatcggtcgcagaagatcccgccccagtacgcgctcagcgccgaggaggagcgcatcctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcagccgccatgaactctgactatttcaccaacgccatcctgaatccccactggcttccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaggaggagtacttgaatgactccctgctgagacccgagcgggagaagaacttccccaataacgggatagagagcctggtggacaagatgagccgatggaagacgtatgcgcaggagcacagggacgatccccgggcgtcgcagggggccacgagccggggcagcgccgcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatagcgaccagcgtgcgttcgtttcttctctgttgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaacggggtcaaagtagatgacacgtatgatggtagtcaggatatcttggagtataagtgggtggagtttgagctgcccgaaggcaacttctcggtgaccatgaccatcgacctgatgaacaacgccatcatcgacaattacttggcggtggggcggcagaacggggtcctggagagcgatatcggcgtgaagttcgacactaggaacttcaggctgggctgggaccccgtgaccgagctggtcatgccaggggtgtacaccaacgaggccttccaccccgatattgtcttgctgcccggctgcggggtggacttcaccgagagccgcctcagcaacctgctgggcattcgcaagaggcagcctttccaggaaggtttccagatcatgtacgatgatctggaggggggcaacatccccgcgctcctggatgtcgaggcctatgaggaaagcaaggaaaaagcagaagccgaggcgactgcagccgtggctactgccgcggccaatgcagatgccaatgtgactagaggcgatacattcgccactcaggcggaggaagcagccgccctagcggtcgccgatgatagtgaaagtaagatagttatcaaaccagtaaaagtggatagcaagaacagaagctacaacgtgctgccggacgaggtaaacaccgcctaccgcagttggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttgacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgacgatctggtggagtttgtgcgcgagttcgccccccggcggcgcgtgcagtggcgcgggcggaaggtgcaaccggtgctgagacccggcaccaccgtggttttcacacccggcgagcgctccggcaccgcttccaagcgctcctacgacgaggtgtacggggatgatgatatcctggagcaggcggccgagcgcctgggcgagtttgcttacggcaagcgcagccgccccgcggcgcccccagaagcggtgtccatcccgctggaccacggcaaccccacgccgagcctcaagcccgtgaccctgcagcaggtgctgccgagcgcggcgccgcgccggggcttcaagcgcgagggcgaggatctgtaccccaccatgcagctgatggtgcccaagcgccagaagctggaagacgtgctggagaccatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcggccgctcctagaccccggcgcaagtacggcgcggccagcctgctgatgcccaactacgcgctgcatccttccatcatccccacgccgggctaccgcggcacgcgcttctaccgcgggcagaccacccgccgccgccgcaagaccactcgccgccgccgtcgccgcacagccgctgcaacttccgccgccgccctggtgcggagagtgtaccgccgcggccgcgcgcctctgaccctgccgcgcgcgcgctaccacccgagcatcgccatttaaacactttcgcgcctgctttgcagatggccctcacttgccgcattcgcgttcccattgcgggctaccgaggaagaaaaccgcgccgtagaaggctggcggggagcgggatgcgtcgccacccccaccggcggcggcgcgccatcagcaagcggttggggggaggcttcctgcccgcgctgatccccatcatcgccgcggcgatcggggcgatccccggcatcgcttccgtggcggtacaggcctctcagcgccactgagacacttggaacatcttgtaataaaaaaccaatggactctgacgctcctggtcctgtgatgtgttttcgtagacagatggaagacatcaatttttcgtccctggctccgcgacacggcacgcggccgttcatgggcacctggagcgacatcggcaacagccatctgaacgggggcgccttcaattggagcagtctctggagcgggcttaagaatttcgggtccacgcttaaaacctatggccacaaggcgtggaacagcaacacagggcaggcgctgagggaaaagctgaaagagcagaacttccagcagaaggtggtcgatggcctcgcctcgggcatcaacggggtggtggacctggccaaccaggccgtgcagcggcagatcaacagccgactggagccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtgaaactgggcctgcccaccacgcggcccatcgcgcccctggccaccggggtgctgaaacccgagtctaagcccgcgaccctggacttgcctcctcccccgacatcccgcccctccacagtggctaagcccctgccgccggtggcccgcgcgcgacccgggagccgcccgcaggcgaactggcagagcactctgaacagcatcgtgggtctgggagtgcagagtgtgaagcgccgccgctgctattaaacaacataccgtagcgcttaacttgcttgtctgtgtgtgtatgtattatgtcgccgccgctgtcgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggcccccaagggagctcccaattccagccagtgggagcaagcaaaaacaggcaatgggggaactatggaaacacacacatatggtgtggccccaatgggcggagagaatattacaaaagatggtcttcaaattggaacagatgctacagcggatcagaataaaccaatttatgctgacaaaacattccagccagaaccccaagtaggagaagaaaattggcaagaaactgaaagcttttatggtggtagggctcttaaaaaagatacaaacatgaaaccttgctacggctcctatgctagacccactaatgaaaagggaggacaagctaaacttaaagttggagatgatggagttccaaccaaagaatttgatatagacctggctttctttgatactcccggtggtactgtgaatggccaagatgagtataaagcagacattgtcatgtataccgaaaacgcgtatctggaaactccagacacacatgtggtatacaaaccaggcaaggaagatgcaagttctgaaattaacctggttcagcagtccatgcccaacaggcccaactacattgggttcagagacaactttattggtctcatgtactacaacagcactggcaacatgggggtgctggctggtcaggcctcacagttgaatgctgtggttgacttgcaagacagaaacactgaactgtcctaccagctcttgcttgactctctgggtgacagaaccaggtatttcagtatgtggaatcaggcggtggatagctatgaccctgatgtgcgcatcattgaaaaccatggtgtggaggatgaattgccaaactattgcttccccttggatgggtccggcactaacgccgcttaccaaggtgtaaaagtaaaaaatggtgaagatggtgatcttgagagcgagtgggaaaatgatgatactgtggcagctcgaaatcaattatgtaaaggcaacatttttgccatggaaatcaacctccaagccaacctgtggaggagtttcctctactcgaacgtggccctgtacctgcccgattcttacaagtacacgccggccaacatcactctgcccaccaacaccaacacctacgattacatgaatgggagagtggtgcctccctcgctggtggacgcctacatcaacatcggggcgcgctggtcgctggaccccatggacaacgtgaaccccttcaaccaccaccgcaacgcgggcctgcgctaccgctccatgctcctgggcaacgggcgctacgtgcccttccacatccaggtgccccagaagttcttcgccatcaagagcctcctgctcctgcccgggtcctacacctacgagtggaacttccgcaaggacgtcaacatgatcctgcagagctccctcggcaacgacctgcgcacggacggggcctccatccagttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggctaacgccaccaacgtgcccatctccatcccctcgcgcaactgggccgccttccgcggctggtccttcacgcgcctcaagacccgcgagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgaggggtacaacgtggcccagtgcaacatgaccaaggactggttcctggtccagatgctggcccactacaacatcggctaccagggcttccacgtgcccgagggctacaaggaccgcatgtactccttcttccgcaacttccagcccatgagccgccaggtggtcgacgaggtcaactacaaggactaccaggccgtcaccctggcctaccagcacaacaactcgggcttcgtcggctacctcgcgcccaccatgcgccagggccagccctaccccgccaactacccctacccgctcattggcaagagcgccgtcaccagcgtcacccagaaaaagttcctctgcgaccgcgtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtcagagtgcaccagccccaccgcggcgtcatcgaggccgtctacctgcgcacccccttctcggccggtaacgccaccacctaagctcttgcttcttgcaagcagctatggcctgcgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggagcccaccctgcgccgcaaccaagaggcgctctaccgcttcctcaactcccactccgcctactttcgctcccaccgcgcgcgcatcgagaaggccaccgccttcgaccgcatgaatcaagacatgtaaaccgtgtgtgtatttttatctgtgtctttaataaacagcgcttttatgtgacatgcatctctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgtttcacgctcgccagcaccgtcgcgtcggtgatactctccacgtcaaggtcctcggcgttggccatcccgaagggggtcatcttgcaggtctgccggcccatggtgggcacgcacccgggcttgtggttgcaatcgcagtgcagggggatcagcatcatctgggcctggtcggcgttcatccccgggtacatggccttcatgaacgcctccagctgtctgaaggcctgctgggccttggctccttcggtgaaaaagaccccgcaggacttgctagagaactggttggtagcgcagccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgaccatgtgctccttctggatcatggtgctgccgtgcaggcaccgcagcttgccctcggcctcggtgcacccatgcagccacagcgcgcacccggtgcactcccagttcttgtgggcgatctgggaatgcgagtgcacgaagccctgcaggaagcggcccatcatggtcgtcagggtcttgttgctggtgaaggtcagcgggatgccgcggtgctcctcgttgatgtacaggtggcagatgcggcggtacacctcgccctgctcgggcatcagctggaagttggatttcagctcgctttccacgcggtagcggtccatcagcagagccatgatttccatgcccttctcccaggccgagacgatgggcaggctcatggggttcttcaccatcatcttggagctagccgccgcagccagggggtcgctctcgtccagggtctcaaagctccgcttgccgtccttctcggtgatccgcacgggggggtagctgaagcccacggccgccagctcctcctcggcctgtctttcgtcctcgctgtcctggctgacgtcctgcaggaccacatgcttggtcttgcggggcttcttcttgggcggcagcggcggcggctgttcctgaggcgagggggagcgcgagtgctcgctcaccaccacaatttcttcttcttggtccgaggccacgcggcggtaggtatgtctcttcaggggcagaggcggaggcgacgggctctcctcgcggcccggcgggtggctggcagagccccttccgcgttcgggggtgcgctcccggcggcgctctgactgacttcctccgcggccggccattgtgttctcctagggaacaacaacaagcatggagactcagccatcgtcgccaacctcgccatctgcccccaccaccgccgacgagaagcagcagcagcagaatgaaagcttaaccgccccgccgcccagccccgcctccgacgcggccgcggtcccagacatgcaagagatggaggaatccatcgagattgacctgggctatgtgacgcccgcggagcacgaggaggagctggcagtgcgcttttcatcgagccaggaagaaaaagaacagcagccagaacaggaagcagagagcgagcagagtcaggctgggctcgagcatggcgactacctccacctgagcgggggggaggacgcgctcatcaagcatctggcccggcaggccctcatcgtcaaggacgcgctgctcgaccgcatcgaggtgcccctcagcgtggaggagctcagccgcgcctacgagctgaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgccctcttcaacctgggccccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcccgcttggcggtgctcaagcgcacggtcgagctgacccatttcgcctacccggccctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctacccctcagagtttggaagagcggcgcaagctcatgatggccgtggtcctggtgaccgtggagctggagtgcttgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcaacgagcgaaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcttgcaacccccagctgctgagcgagacccagatcatcggcaccttcgagttgcaagggcccagcgatgagggttcagccaaggggagtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaacttcccccgcaacatcttgcattactaccgtcacctccacagcccctactacttccaagaagaggcaacagcagcagaaaaagaccagaaaaccagcagcagctagaaaatccacagcggcaggtggactgaggatcgcagcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagccgcagaaaaaggcgggaattacgtcacctgtgcccttcgccctagccgcctccacccatcatcatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaaatcgccggatcggggagatcttccttcacgcctcgtcaggcggtcctgaccttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcagtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagccagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccggtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttcagacccttcctccccggcacctatcagtgcatctcgggaccctgccatcacaccttccacctgatcccgaataccaccacctcttccccagcgccgctccccactaacaaccaaactaaccaccaccaacgccaccgtcgagacctcgttgaatctaataccacccacaccggaggtgagctccgaggtcctgaatcctctgggatttattacggcccctgggaggtggtggggttaatagctttaggcttagtagcgggtgggcttttggctctctgctacctatacctcccttgcttttcctacttagtggtgctttgttgctggtttaagaaatggggaagatcaccctagtgtgcggtgtgctggtgacggtggtgctttcgattctgggagggggaagcgcggctgtagtgacggagaagaaggccgatccctgcttgactttcaaccccgataactgccggctgagttttcagccagatggcaatcggtgtgcggtgttgatcaagtgcggatgggaatgcgagagcgtggtgatccagtataaaaacaaaacctggaacaatactctcgcgtccacatggcagcccggggaccccgagtggtacaccgtctctgtccctggtgctgacggctccctccgcacggtgaacaacactttcatttttgagcacatgtgcgaaaccgccatgttcatgagcaagcagtacggtatgtggcccccacggaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacacacttttttcacacactttttcagaccatggcctctgttacttttttgataattgccagtctcattgctgttataagtaatgagaaactcactgtttacattggtactaatcacacactagaaggaattccaaaatcctcatggtattgctattttgatcaaaatccagagctaactgtagaattatgtggtaacagtggaaaaaataaaagcattcatttaattaactttgggtgcggaaaagatttgatactaattaatatcactagagagtatgcaggtatgtactactacgccacagaaggcatttcaaacatgcaattttatgaagttactgtgtctgaacctaccacgcctaaaatgaccacaaccacaaagactacagttgtcagcactatacatctcagtaccaatggcatttttgctatgcttcagatggccaataacagcaccagcatgccacacacacctacactacctagtgaggaaatacctaaatccatggtcgccatcatagctgctgtagtggtgtgtatgctgattattgttttgtgcatggcctactacgcttgctactacagaaggcacagactaagcgacaagctggaccaattactgagtgttgaattttaattttttagaaccatgaagatcctagccctttttgttttatctataattacatctgctctatgcaattctgacaatgaggatgttactgtcattgtcggatccaattacacactaaaaggcccaaccgagggtatgctttcgtggtattgctattttggaactgatactaagcaaacagagctctgtaatgctatgaaaggtcagatgcctacttccagaattaaacataaatgtaatggtactgacctaatactactcaatatcacaaaagcatatgctggcagttattcctgccctgcggccaacactgaggatatgattttttacaaagtaactgttgttgatcccaccactccaccaccacccaccacaactactaaagctaccacacacacacagcaaaccacaccagataaggggtttgccttaaaagttcagcaagaaggcggggcttcttttggagctaagacccctactcctgatcctcactgtccagggccattagtcagcagcattgtcggtgtgctttgtggtttagcaattgtgatcatctgcttgttcatttttgcttgctgctacagaaggcttcaccgacaaaaatcagacccactgctgaacctctatgtttaattttaatttcagaaccatgaaggcacttatcactttagtttttctttctttaattggcactgtttttagtgttagttttttgaaaaaaatcaatgtcactgagggagataatgtgacattggttggtgtagaaggtgctgaaaataccacctggacaaaatatcacatggatgggtggaaagaaatttgcacctggaatgtcactacttatacatgtgagggagttaaccttaccattgtcaatgttagcgaaattcaaaagggttggattaaagggcagagtgttagtgtcaccagtgagggatattttacccaacatacttttatctatgacattattgtcataccactgcccacacctagcccacctagcactactcagaccacacaaacaacctacactacacagagctccacaactaccttgcaaaccactcagacaaccacttacactacatccactcagcccaccaccactacagcagaggcgagtagctcaccaaccatcaaagtggcatttttgttactgccaccatctagcagtcctgctagtaccaatgagcagactactgaatttttgtccactattcagagcagcaccacagctacctcgagtgccttctctagcaccgccaatctcacctcgctttcctctacgccaatcagtaatgctactacctccccagctcctcttcccactcctctgaagcaatcagagtctagcacgcagctgcagatcaccctgctcattgtgatcggggtggtcatcctggcagtgctgctctactttatcttctgccgccgcatccccaacgcgaagccggcctacaagcccattgttatcggcacgccggagccgcttcaggtggagggaggtctaaggaatcttctcttctcttttacagtatggtgatttgaactatgattcctagacatttcattatcacttctctaatctgtgtgctccaagtctgtgccaccctcgctctcgtggctaacgcgagtccagactgcattggagcgttcgcctcctacgtgctctttgccttcatcacctgcatctgctgctgtagcatagtctgcctgcttatcaccttcttccagttcgttgactgggtctttgtgcgcatcgcctacctgcgccaccatccccagtaccgcgaccagagagtggcgcaactgttgagactcatctgataagcatgcgggctctgctacttctcgcgcttgtgctagctcccctcgccgcccccttaaccctcaaatcccccacccagtcccctgaagaggttcgaaaatgtaaattccaagaaccctggaaattcctttcatgctacaaactcaaatcagaaatgcaccccagctggatcatgatcattggaatcgtgaacatccttgcctgtaccctcatctcctttgtgatttacccctgctttaactttgggtggaacgcacccgaggcgctctggctcccgcctgatcccgacacaccaccacagcagcagcaaaatcaggcacatgcaccaccacagcctaggccacaatacatgcccatcttagactatgaggccgagccacagcgagccatgcttcctgctattagttacttcaatctaaccggcggagatgactgaccccatggccaacaacaccgtcaacgacctcctggacatggacggccgcgcctcggagcagcgactcgcccaactccgcatccgccagcagcaggagagagccgtcaaggagctgcaggatgcggtggccatccaccagtgcaagaaaggcatcttctgcctggtgaagcaggccaagatcaccttcgaggtgacttccaccgaccatcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccttgatcaagaccctctgcggcctccgcgacctcctccccatgaactaatcaactaacccctacccctttaccctccagtaaaaataaagattaaaaagagatgatgatgatttgaattgatcaataaagaatcacttacttgaaatctgaaaccaggtctctgtccatgttttctgtcagcagcacttcactcccctcttcccagctctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgtctggccgaccccgtcaccaccaagaacggggctgtcaccctcaagctgggggagggggtggacctcgacgactcgggaaaactcatctccaaaaatgccaccaaggccactgcccctctcagtatttccaacaacaccatttcccttaacatggatacccctttttacaacaacaacggaacgctaggcatgaaggtaactgcaccactaaagatcttagacacaaatctactaaaaacacttgttgttgcttatgggcagggattaggaacaagcaccactggtgctcttgttgctcaactagcatacccacttgtttttaataccgataacaaaattgcccttaatttaggcaatggaccattaaaagtggatgcaaataaactgaacattaattgcaaaagaggtctctatgtcacccccacaaaagatgcactggagattaatatcagttgggcaaatgctatgacatttataggaaatgccattggtgtaaatattgacacaaaaaaaggcctacagtacggcacttcaagcactgaaacagatgttaaaaatgcttttccactccaagtaaaacttggagctggtcttacatttgacagcacaggtgccattgttgcttggaacaaagatgatgataaacttacactatggaccatggctgacccatctccaaactgtcacatatattctgaaaaggatgctaagcttacactctgcttaacaaagtgtggcagtcagatactgggcactgtttccctactggctgtcgacaatggaagcttaaacccaataacaggaaaagtaaccacagctcttgtttcgctgaaatttgatgccaatggagttttgcaagacagttcgacacttgacaaagactattggaatttcagacaaggtgatgctacacctgctgaaccctataccaatgctataggttttatgcccaatctaaaagcatacccaaaaaacacaaatggagctgcaaaaagtcatattgttggaaaagtataccttcatggtgatgtaagcaagccgcttaatctgataattacttttaatgaaaccagtgatgaatcctgtacttattgtattaactttcagtggcagtggggaactgaccaatataaaactgaaacacttgcagtcagttcattcacattctcctacattgccaaggaataaaccctgcatgacaacccattcccaccactgtatctacaatggaaaactctgaagcagaaaaataaagttcaagtgttttattgattcaacagttttcacaggattcgagtagttattttccctcctccctcccaactcatggaatacaccaccctctccccacgcacagccttaaacatctgaatgccattggtaatggacatggttttggtctccacattccacacagtttcagagcgagccagtctcgggtcggtcagggagatgaaaccctccgggcactcctgcatctgcacctcaaagttcagtagctgagggctgtcctcggtggtcgggatcacagttatctggaagaagagcgatgagagtcataatccgcgaacgggatcgggcggttgtggcgcatcaggccccgcagcagtcgctgtctgcgccgctccgtcaagctgctgctcaaggggtccgggtccagggactccctgcgcatgatgccgatggccctaagcatcagtcgcctggtgcggcgggcgcagcagcggatgcggatctcactcaggtcggagcagtatgtgcagcacagcaccaccaagttgttcaacagtccatagttcaacacactccagccaaaactcatctgtggaactatgctgcccacatgtccatcgtaccagatcctgatgtaaatcaggtggcgccccctccagaacacactgcccatgtacatgatctccttgggcatatgcaggttcaccacctcccggtaccacatcacccgctggttaaacatgcagccctggataatcctgcggaaccagatggccagcaccgccccgcccgccatgcagcgcagggaccccgggtcctggcaatggcagtggatgatccaccgctcgcggccgtggatcagctgggagctgaacaagtctatgttggcacagcacaggcacacgctcatgcatgtcttcagcactctcagttcctcgggggtcaagaccatgtcccagggcacggggaactcttgcaggacagtgaacccggcagaacagggcaaccctcgcacacaacttacattgtgcatggacagggtatcgcaatcaggcagcaccggatgatcctccaccagagaagcacgggtctcggtctcctcacagcgaggtaaggggaccggcggttggtacggatgatggcgggatgacgctaatcgtgttctggatcgtgtcatgatggagctgtttcctgacattttcgtacttcacgaagcagaatctggtccgggcactgcacaccgctcgtcggcgacggtctcggcgcttcgagcgctcggtgttgaagttatagaacagccactccctcagagcgtgcagtatctcctgagcctcttgggtgatgaaaatcccatccgccctgatggctctgatcacatcgaccacggtggaatgggccagacccagccagatgatgcaattttgttgggtttcggtgacggcgggggagggaagaacaggaagaaccatgattaactttattccaaacggtctcggagcacttcaaaatgcaggtcccggaggtggcacctctcgcccccactgtgttggtggaaaataacagccaggtcaaaggtgacacggttctcgagatgttccacggtggcttccagcaaagcctccacgcgcacatccagaaacaagaggacagcgaaagcgggagcgttttctaattcctcaatcatcatattacactcctgcaccatccccagataattttcatttttccagccttgaatgattcgtattagttcctgaggtaaatccaagccagccatgataaaaagctcgcgcagagcgccctccaccggcattcttaagcacaccctcataattccaagagattctgctcctggttcacctgcagcagattaacaatgggaatatcaaaatctctgccgcgatccctaagctcctccctcaacaataactgtatgtaatctttcatatcatctccgaaatttttagccataggaccgccaggaataagagaagggcaagccacattacagataaagcgaagtcctccccagtgagcattgccaaatgtaagattgaaataagcatgctggctagaccctgtgatatcttccagataactggacagaaaatcaggcaagcaatttttaagaaaatcaacaaaagaaaagtcgtctaggtgcacgtttagagcctcaggaacaacgatggaataagtgcaaggagtgcgttccagcatggttagtgtttttttggcgatctgtagaacaaaaaataaacatgcaatattaaaccatgctagcctggcgaacaggtggataaatcactctttccagcaccaggcaagctacggggtctccggcacgaccctcgtagaaactgtcaccgtgattgaaaagcatcaccgaaagagtctcccggtggccggcatggatgattcgagaagaagcatacactccgggaacattggcgtccgtgagtgaaaaaaagcgacccaggaagccccgaggcactacaatgctcaatctcagttccagcagggcgaccccatgcggatgaagcacaaaattggcaggtgcgtaaaaaatgtaattactcccctcctgcacaggcagcaaagcccccgctccctccagaaacacatacaaagcctcagcgtccatagcttaccgagcacggcaggcgcaagagtcagagaaaaggctgagctctaacctgactgcccgctcctgagctcaatatatagccctaacctacactgacgtaaaggccaaagtctaaaaatacccgccaaaatgacacacacgcccagcacacgcccagaaaccggtgacacactcaaaaaaatacgtgcgcttcctcaaacgcccaaaccagcgtcatttccgggttcccacgctacgtcaccgctcagcgactttcaaattccgtcgaccgttaaaaacgtcactcgccccgcccctaacggtcgctcatccctcgtccaatcacaacgccccatccccaaattcaaacagctcatttgcatattaacgcgcaccaaaagtttgaggtatattattgatgatgatcatttaaatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaag

SEQ ID NO: 169 - protein, 363 aa, Artificial Sequence
  Synthetic Construct
MGARASVLSGGELDRWEKIRLRPGGKKKYKLKHIVWASRELERFAVNPGLLETSEGCRQILGQLQPSLQTGSEELRSLYNTVATLYCVHQRIEIKDTKEALDKIEEEQNKSKKKAQQAAADTGHSNQVSQNYPIVQNIQGQMVHQAISPRTLNAWVKVVEEKAFSPEVIPMFSALSEGATPQDLNTMLNTVGGHQAAMQMLKETINEEAADWDRVHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVL

SEQ ID NO: 170 - protein, 130 aa, Artificial Sequence
  Synthetic Construct
HMLATVHVASHSRKPWPEFEHNVMTRCNMHLGSRRGMFMPYQCNLNYVKVLLEPDAMSRVSLTGVFDMNVEVWKILRYDESKTRCRACECGGKHARFQPVCVDVTEDLRPDHLVLSCTGTEFGSSGEESD

SEQ ID NO: 171 - protein, 142 aa, Artificial Sequence; identical to SEQ ID NO: 3
  Synthetic Construct

SEQ ID NO: 172 - protein, 592 aa, Artificial Sequence; identical to SEQ ID NO: 4
  Synthetic Construct

SEQ ID NO: 173 - protein, 540 aa, Artificial Sequence; identical to SEQ ID NO: 5
  Synthetic Construct

SEQ ID NO: 174 - protein, 193 aa, Artificial Sequence; identical to SEQ ID NO: 6
  Synthetic Construct

SEQ ID NO: 175 - protein, 338 aa, Artificial Sequence; identical to SEQ ID NO: 7
  Synthetic Construct

SEQ ID NO: 176 - protein, 77 aa, Artificial Sequence; identical to SEQ ID NO: 8
  Synthetic Construct

SEQ ID NO: 177 - protein, 254 aa, Artificial Sequence; identical to SEQ ID NO: 9
  Synthetic Construct

SEQ ID NO: 178 - protein, 942 aa, Artificial Sequence; identical to SEQ ID NO: 10
  Synthetic Construct

SEQ ID NO: 179 - protein, 207 aa, Artificial Sequence; identical to SEQ ID NO: 11
  Synthetic Construct

SEQ ID NO: 180 - protein, 803 aa, Artificial Sequence; identical to SEQ ID NO: 12
  Synthetic Construct

SEQ ID NO: 181 - protein, 227 aa, Artificial Sequence; identical to SEQ ID NO: 13
  Synthetic Construct

SEQ ID NO: 182 - protein, 176 aa, Artificial Sequence; identical to SEQ ID NO: 23
  Synthetic Construct

SEQ ID NO: 183 - protein, 201 aa, Artificial Sequence; identical to SEQ ID NO: 15
  Synthetic Construct

SEQ ID NO: 184 - protein, 205 aa, Artificial Sequence; identical to SEQ ID NO: 16
  Synthetic Construct

SEQ ID NO: 185 - protein, 91 aa, Artificial Sequence; identical to SEQ ID NO: 17
  Synthetic Construct

SEQ ID NO: 186 - protein, 134 aa, Artificial Sequence; identical to SEQ ID NO: 25
  Synthetic Construct

SEQ ID NO: 187 - protein, 445 aa, Artificial Sequence; identical to SEQ ID NO: 19
  Synthetic Construct

SEQ ID NO: 188 - DNA, 31440 bp, Artificial Sequence
  Simian adenovirus A1321 clone
  CDS (25494)..(26054): 22K
  CDS (27360)..(27995): E3\CR1-alpha
  CDS (29768)..(30685): E3\CR1-delta
  CDS (30978)..(31406): E3\RID-beta
aattatttaaatccccatcatcaataatatacctcaaacttttggtgcgcgttaatatgcaaatgagctgtttgaatttggggatggggcgttgtgattggacgagggatgagcgaccgttaggggcggggcgagtgacgttttgatgacgtggccgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatgacagggaggagtatttgccgagggccgagtagactttgaccgattacgtgggggtttcgattaccgtgtttttcacctaaatttccgcgtacgtaactataacggtcctaaggtagcgaaagctcagatctggatctcccgatcccctatggcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacagagagatgggtgcgagagcgtcagtattaagcgggggagaattagatcgatgggaaaaaattcggttaaggccagggggaaagaagaagtacaagctaaagcacatcgtatgggcaagcagggagctagaacgattcgcagttaatcctggcctgttagaaacatcagaaggctgtagacaaatactgggacagctacaaccatcccttcagacaggatcagaggagcttcgatcactatacaacacagtagcaaccctctattgtgtgcaccagcggatcgagatcaaggacaccaaggaagctttagacaagatagaggaagagcaaaacaagtccaagaagaaggcccagcaggcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaggacctgaacacgatgttgaacaccgtggggggacatcaagcagccatgcaaatgttaaaagagaccatcaatgaggaagctgcagattgggatagagtgcatccagtgcatgcagggcctattgcaccaggccagatgagagaaccaaggggaagtgacatagcaggaactactagtacccttcaggaacaaataggatggatgacaaataatccacctatcccagtaggagagatctacaagaggtggataatcctgggattgaacaagatcgtgaggatgtatagccctaccagcattctggacataagacaaggaccaaaggaaccctttagagactatgtagaccggttctataaaactctaagagctgagcaagcttcacaggaggtaaaaaattggatgacagaaaccttgttggtccaaaatgcgaacccagattgtaagaccatcctgaaggctctcggcccagcggctacactagaagaaatgatgacagcatgtcagggagtaggaggacccggccataaggcaagagttttgtagggatccactagttctagactcgagggggggcccggtacctttaagaccaatgacttacaaggcagctgtagatcttagccactttttaaaagaaaaggggggactggaagggctaattcactcccaaagaagacaagataaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcacatatgctggccaccgtgcatgtggcttcccattcccgcaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggatgtgacggaggacctgcgacccgatcatttggtgttgtcctgcaccgggacggagttcggttccagcggggaagaatctgactagagtgagtagtgttctggggcggtggagggcatgcatgagggccagaatgactgaaatctgtgcttttctgtgtgttgcagcagcatgagcggaagcggctcctttgagggaggggtattcagcccttatctgacggggcgtctcccttcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctattacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcatggtgttgcacaatatctttgaggaggagactgatggccacgggcagccctttagtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttggaagggaaggcgtgaaagaatttggcgacgcccttgtgcccgcccaggttttccatgcattcatccatgatgatggcgatgggcccgtgggcggcggcctgggcaaagacgtttcgggggtcggacacatcatagttgtggtcctgggtgagatcatcataggccattttaatgaatttggggcggagggtgccggactgggggacaaaggtaccctcgatcccgggggcgtagttcccctcacagatctgcatctcccaggctttgagctcggagggggggatcatgtccacctgcggggctataaagaacacggtttccggggcgggggagatgagctgggccgaaagcaagttccggagcagctgggacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgcttcaggctcatccggctggttgaaaaccgctcccgatcggcgccctgcgcgtcggccaggtagcaattgaccatgagttcgtagttgagcgcctcggccgcgtggcctttggcgcggagcttacctttggatgtctgcccacaggcgggacagaggagggacttgagggcgtagagcttgggggcaaggaagacggactcgggggcgtaggcatccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgaaacgaaagcccgggtccaggccagcacgaaggaggccacgtgggacgggtagcggtcgttgtccaccagcgggtccaccttctccagggtatgcaaacacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagtccctcgtccatctggtcagaaaagacgatctttttattgtcgagtttggtggcgaaggagccgtagagggcgttggaaaggagcttggcgatggagcgcatggtctggttcttttccttgtcggcgcgctccttggccgcgatgttgagttgcacgtactcgcgcgccacgcacttccattcggggaagacggtggtcagctcgtcgggcacgattctgacctgccagccccgattatgcagggtgatgaggtccacactggtggccacctcgccgcgcaggggttcattagtccagcagaggcgcccgcccttgcgcgagcagaaggggggcagggggtcgagcatgacctcgtcgggggggtcggcatcgatggtgaagatgccgggcaggaggtcgggatcaaagtagctgatagaagtggccagatcgtccagggaagcttgccattcgcgcacggccagcgcgcgctcgtagggactgaggggcatgccccagggcatggggtgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggtgcgaggagccccgggcccaggttggtgcggctgggcttttcggcgcggtagacgatctggcggaaaatggcatgcgagttggaggagatggtgggcctttggaagatgttgaagtgggcgtggggcagtccgaccgagtcgcggatgaagtgggcgtaggagtcttgcagcttggcgacgagctcggcggtgacgaggacgtccagagcgcagtagtcgagggtctcctggatgatgtcatacttgagctgacccttttgtttccacagctcgcggttgagaaggaactcttcgcggtccttccagtactcttcgagggggaacccgtcctgatcggcacggtaagagcctagcatgtagaactggttgacggccttgtaggcgcagcagcccttctccacggggagggcgtaggcctgggcggctttgcgcagggaggtgtgcgtgagggcgaaagtgtccctgaccatgactttgaggaactggtgcttgaagtcgatatcgtcgcagcccccctgctcccagagttggaagtccgtgcgcttcttgtaggcggggttgggcaaagcgaaagtaacatcgttgaagaggatcttgcccgcgcggggcataaagttgcgagtgatgcggaaaggttggggcacctcggcccggttgttgatgacctgggcggcgagcacgatctcgtcgaagccgttgatgttgtggcccacgatgtagagttccacgaaccgtgggcggcccttgacgtggggcagcttcttgagctcttcgtaggtgagctcgtcggggtcgctgagcccgtgctgctcgagcgcccagtcggcgagatgggggttggcgcggaggaaagaagtccagagatccacggccagggcggtttgcaggcggtcccggtactgacggaactgctgcccgacggccattttttcgggggtgacgcagtagaaggtgcgggggtccccgtgccagcgatcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcagcccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggagtgaccaccgtcccccgtttcttcttgggcggctggggcgacgggggcggtgtttccatctcggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcggcggagcggcatctcgctgacgtcgcccagcgcctccaagcgttccatggcctcgtaaaagtccacggcgaagttgaaaaactgggagttacgcgccgagacggtcaactcctcctccagaagacggatgagctcggcgatggtggcgcgcacctcgcgctcgaaggcccccgggagttcctcctcttccatctcttcttcctcctccactaacatctcttctacttcctcctcaggcggcagtggtggcgggggagggggcctgcgtcgccggcggcgcacgggcagacggtcgatgaagcgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctgccgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaactttttggaggccggaaatgagactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcagcagcaacttccagccacgaccgccgcggccgccgtgagcgggactggacagacttctcagtatgaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggacagaaagagggtgctgagggacgaggatttcgaggcggacgagctgacggggatcagccccgcgcgtgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcaacatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccctacgtagaagaggtggacgatgaggtggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccctggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggcgttcaagaacttgcagggcctctggggcgtgcaggccccggtcggggaccgcgcgacggtgtcgagcctgctgacgccgaactcgcgcctgctgttgctgctggtggctcccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggaaatctggaagccaccctgaactttttgctgaccaatcggtcgcagaagatcccgccccagtacgcgctcagcgccgaggaggagcgcatcctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcagccgccatgaactctgactatttcaccaacgccatcctgaatccccactggcttccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaggccgccagtcctttcccgagcttgcccttctcgctgaacagtatccgcagcagcgagctgggcaggatcacgcgcccgcgcttgctgggcgaggaggagtacttgaatgactccctgctgagacccgagcgggagaagaacttccccaataacgggatagagagcctggtggacaagatgagccgatggaagacgtatgcgcaggagcacagggacgatccccgggcgtcgcagggggccacgagccggggcagcgccgcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatagcgaccagcgtgcgttcgtttcttctctgttgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaacggggtcaaagtagatgacacgtatgatggtagtcaggatatcttggagtataagtgggtggagtttgagctgcccgaaggcaacttctcggtgaccatgaccatcgacctgatgaacaacgccatcatcgacaattacttggcggtggggcggcagaacggggtcctggagagcgatatcggcgtgaagttcgacactaggaacttcaggctgggctgggaccccgtgaccgagctggtcatgccaggggtgtacaccaacgaggccttccaccccgatattgtcttgctgcccggctgcggggtggacttcaccgagagccgcctcagcaacctgctgggcattcgcaagaggcagcctttccaggaaggtttccagatcatgtacgatgatctggaggggggcaacatccccgcgctcctggatgtcgaggcctatgaggaaagcaaggaaaaagcagaagccgaggcgactgcagccgtggctactgccgcggccaatgcagatgccaatgtgactagaggcgatacattcgccactcaggcggaggaagcagccgccctagcggtcgccgatgatagtgaaagtaagatagttatcaaaccagtaaaagtggatagcaagaacagaagctacaacgtgctgccggacgaggtaaacaccgcctaccgcagttggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttgacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgacgatctggtggagtttgtgcgcgagttcgccccccggcggcgcgtgcagtggcgcgggcggaaggtgcaaccggtgctgagacccggcaccaccgtggttttcacacccggcgagcgctccggcaccgcttccaagcgctcctacgacgaggtgtacggggatgatgatatcctggagcaggcggccgagcgcctgggcgagtttgcttacggcaagcgcagccgccccgcggcgcccccagaagcggtgtccatcccgctggaccacggcaaccccacgccgagcctcaagcccgtgaccctgcagcaggtgctgccgagcgcggcgccgcgccggggcttcaagcgcgagggcgaggatctgtaccccaccatgcagctgatggtgcccaagcgccagaagctggaagacgtgctggagaccatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcggccgctcctagaccccggcgcaagtacggcgcggccagcctgctgatgcccaactacgcgctgcatccttccatcatccccacgccgggctaccgcggcacgcgcttctaccgcgggcagaccacccgccgccgccgcaagaccactcgccgccgccgtcgccgcacagccgctgcaacttccgccgccgccctggtgcggagagtgtaccgccgcggccgcgcgcctctgaccctgccgcgcgcgcgctaccacccgagcatcgccatttaaacactttcgcgcctgctttgcagatggccctcacttgccgcattcgcgttcccattgcgggctaccgaggaagaaaaccgcgccgtagaaggctggcggggagcgggatgcgtcgccacccccaccggcggcggcgcgccatcagcaagcggttggggggaggcttcctgcccgcgctgatccccatcatcgccgcggcgatcggggcgatccccggcatcgcttccgtggcggtacaggcctctcagcgccactgagacacttggaacatcttgtaataaaaaaccaatggactctgacgctcctggtcctgtgatgtgttttcgtagacagatggaagacatcaatttttcgtccctggctccgcgacacggcacgcggccgttcatgggcacctggagcgacatcggcaacagccatctgaacgggggcgccttcaattggagcagtctctggagcgggcttaagaatttcgggtccacgcttaaaacctatggccacaaggcgtggaacagcaacacagggcaggcgctgagggaaaagctgaaagagcagaacttccagcagaaggtggtcgatggcctcgcctcgggcatcaacggggtggtggacctggccaaccaggccgtgcagcggcagatcaacagccgactggagccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtgaaactgggcctgcccaccacgcggcccatcgcgcccctggccaccggggtgctgaaacccgagtctaagcccgcgaccctggacttgcctcctcccccgacatcccgcccctccacagtggctaagcccctgccgccggtggcccgcgcgcgacccgggagccgcccgcaggcgaactggcagagcactctgaacagcatcgtgggtctgggagtgcagagtgtgaagcgccgccgctgctattaaacaacataccgtagcgcttaacttgcttgtctgtgtgtgtatgtattatgtcgccgccgctgtcgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacagcctggcccccaagggagctcccaattccagccagtgggagcaagcaaaaacaggcaatgggggaactatggaaacacacacatatggtgtggccccaatgggcggagagaatattacaaaagatggtcttcaaattggaacagatgctacagcggatcagaataaaccaatttatgctgacaaaacattccagccagaaccccaagtaggagaagaaaattggcaagaaactgaaagcttttatggtggtagggctcttaaaaaagatacaaacatgaaaccttgctacggctcctatgctagacccactaatgaaaagggaggacaagctaaacttaaagttggagatgatggagttccaaccaaagaatttgatatagacctggctttctttgatactcccggtggtactgtgaatggccaagatgagtataaagcagacattgtcatgtataccgaaaacgcgtatctggaaactccagacacacatgtggtatacaaaccaggcaaggaagatgcaagttctgaaattaacctggttcagcagtccatgcccaacaggcccaactacattgggttcagagacaactttattggtctcatgtactacaacagcactggcaacatgggggtgctggctggtcaggcctcacagttgaatgctgtggttgacttgcaagacagaaacactgaactgtcctaccagctcttgcttgactctctgggtgacagaaccaggtatttcagtatgtggaatcaggcggtggatagctatgaccctgatgtgcgcatcattgaaaaccatggtgtggaggatgaattgccaaactattgcttccccttggatgggtccggcactaacgccgcttaccaaggtgtaaaagtaaaaaatggtgaagatggtgatcttgagagcgagtgggaaaatgatgatactgtggcagctcgaaatcaattatgtaaaggcaacatttttgccatggaaatcaacctccaagccaacctgtggaggagtttcctctactcgaacgtggccctgtacctgcccgattcttacaagtacacgccggccaacatcactctgcccaccaacaccaacacctacgattacatgaatgggagagtggtgcctccctcgctggtggacgcctacatcaacatcggggcgcgctggtcgctggaccccatggacaacgtgaaccccttcaaccaccaccgcaacgcgggcctgcgctaccgctccatgctcctgggcaacgggcgctacgtgcccttccacatccaggtgccccagaagttcttcgccatcaagagcctcctgctcctgcccgggtcctacacctacgagtggaacttccgcaaggacgtcaacatgatcctgcagagctccctcggcaacgacctgcgcacggacggggcctccatccagttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggctaacgccaccaacgtgcccatctccatcccctcgcgcaactgggccgccttccgcggctggtccttcacgcgcctcaagacccgcgagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgaggggtacaacgtggcccagtgcaacatgaccaaggactggttcctggtccagatgctggcccactacaacatcggctaccagggcttccacgtgcccgagggctacaaggaccgcatgtactccttcttccgcaacttccagcccatgagccgccaggtggtcgacgaggtcaactacaaggactaccaggccgtcaccctggcctaccagcacaacaactcgggcttcgtcggctacctcgcgcccaccatgcgccagggccagccctaccccgccaactacccctacccgctcattggcaagagcgccgtcaccagcgtcacccagaaaaagttcctctgcgaccgcgtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtcagagtgcaccagccccaccgcggcgtcatcgaggccgtctacctgcgcacccccttctcggccggtaacgccaccacctaagctcttgcttcttgcaagcagctatggcctgcgcgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggagcccaccctgcgccgcaaccaagaggcgctctaccgcttcctcaactcccactccgcctactttcgctcccaccgcgcgcgcatcgagaaggccaccgccttcgaccgcatgaatcaagacatgtaaaccgtgtgtgtatttttatctgtgtctttaataaacagcgcttttatgtgacatgcatctctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgggagttgcggtacacggggttgcagcactggaacaccatcagggccgggtgtttcacgctcgccagcaccgtcgcgtcggtgatactctccacgtcaaggtcctcggcgttggccatcccgaagggggtcatcttgcaggtctgccggcccatggtgggcacgcacccgggcttgtggttgcaatcgcagtgcagggggatcagcatcatctgggcctggtcggcgttcatccccgggtacatggccttcatgaacgcctccagctgtctgaaggcctgctgggccttggctccttcggtgaaaaagaccccgcaggacttgctagagaactggttggtagcgcagccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgaccatgtgctccttctggatcatggtgctgccgtgcaggcaccgcagcttgccctcggcctcggtgcacccatgcagccacagcgcgcacccggtgcactcccagttcttgtgggcgatctgggaatgcgagtgcacgaagccctgcaggaagcggcccatcatggtcgtcagggtcttgttgctggtgaaggtcagcgggatgccgcggtgctcctcgttgatgtacaggtggcagatgcggcggtacacctcgccctgctcgggcatcagctggaagttggatttcagctcgctttccacgcggtagcggtccatcagcagagccatgatttccatgcccttctcccaggccgagacgatgggcaggctcatggggttcttcaccatcatcttggagctagccgccgcagccagggggtcgctctcgtccagggtctcaaagctccgcttgccgtccttctcggtgatccgcacgggggggtagctgaagcccacggccgccagctcctcctcggcctgtctttcgtcctcgctgtcctggctgacgtcctgcaggaccacatgcttggtcttgcggggcttcttcttgggcggcagcggcggcggctgttcctgaggcgagggggagcgcgagtgctcgctcaccaccacaatttcttcttcttggtccgaggccacgcggcggtaggtatgtctcttcaggggcagaggcggaggcgacgggctctcctcgcggcccggcgggtggctggcagagccccttccgcgttcgggggtgcgctcccggcggcgctctgactgacttcctccgcggccggccattgtgttctcctagggaacaacaacaagcatggagactcagccatcgtcgccaacctcgccatctgcccccaccaccgccgacgagaagcagcagcagcagaatgaaagcttaaccgccccgccgcccagccccgcctccgacgcggccgcggtcccagacatgcaagagatggaggaatccatcgagattgacctgggctatgtgacgcccgcggagcacgaggaggagctggcagtgcgcttttcatcgagccaggaagaaaaagaacagcagccagaacaggaagcagagagcgagcagagtcaggctgggctcgagcatggcgactacctccacctgagcgggggggaggacgcgctcatcaagcatctggcccggcaggccctcatcgtcaaggacgcgctgctcgaccgcatcgaggtgcccctcagcgtggaggagctcagccgcgcctacgagctgaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgccctcttcaacctgggccccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcccgcttggcggtgctcaagcgcacggtcgagctgacccatttcgcctacccggccctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctacccctcagagtttggaagagcggcgcaagctcatgatggccgtggtcctggtgaccgtggagctggagtgcttgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccgccgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcaacgagcgaaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcttgcaacccccagctgctgagcgagacccagatcatcggcaccttcgagttgcaagggcccagcgatgagggttcagccaaggggagtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaacttcccccgcaacatcttgcattactaccgtcacctccacagcccctactacttccaagaagaggcaacagcagcagaaaaagaccagaaaaccagcagcagctagaaaatccacagcggcaggtggactgaggatcgcagcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagccgcagaaaaaggcgggaattacgtcacctgtgcccttcgccctagccgcctccacccatcatcatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaaatcgccggatcggggagatcttccttcacgcctcgtcaggcggtcctgaccttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcagtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagccagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccggtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttcagacccttcctccccggcacctatcagtgcatctcgggaccctgccatcacaccttccacctgatcccgaataccaccacctcttccccagcgccgctccccactaacaaccaaactaaccaccaccaacgccaccgtcgagacctcgttgaatctaataccacccacaccggaggtgagctccgaggtcctgaatcctctgggatttattacggcccctgggaggtggtggggttaatagctttaggcttagtagcgggtgggcttttggctctctgctacctatacctcccttgcttttcctacttagtggtgctttgttgctggtttaagaaatggggaagatcaccctagtgtgcggtgtgctggtgacggtggtgctttcgattctgggagggggaagcgcggctgtagtgacggagaagaaggccgatccctgcttgactttcaaccccgataactgccggctgagttttcagccagatggcaatcggtgtgcggtgttgatcaagtgcggatgggaatgcgagagcgtggtgatccagtataaaaacaaaacctggaacaatactctcgcgtccacatggcagcccggggaccccgagtggtacaccgtctctgtccctggtgctgacggctccctccgcacggtgaacaacactttcatttttgagcacatgtgcgaaaccgccatgttcatgagcaagcagtacggtatgtggcccccacggaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacacacttttttcacacactttttcagaccatggcctctgttacttttttgataattgccagtctcattgctgttataagtaatgagaaactcactgtttacattggtactaatcacacactagaaggaattccaaaatcctcatggtattgctattttgatcaaaatccagagctaactgtagaattatgtggtaacagtggaaaaaataaaagcattcatttaattaactttgggtgcggaaaagatttgatactaattaatatcactagagagtatgcaggtatgtactactacgccacagaaggcatttcaaacatgcaattttatgaagttactgtgtctgaacctaccacgcctaaaatgaccacaaccacaaagactacagttgtcagcactatacatctcagtaccaatggcatttttgctatgcttcagatggccaataacagcaccagcatgccacacacacctacactacctagtgaggaaatacctaaatccatggtcgccatcatagctgctgtagtggtgtgtatgctgattattgttttgtgcatggcctactacgcttgctactacagaaggcacagactaagcgacaagctggaccaattactgagtgttgaattttaattttttagaaccatgaagatcctagccctttttgttttatctataattacatctgctctatgcaattctgacaatgaggatgttactgtcattgtcggatccaattacacactaaaaggcccaaccgagggtatgctttcgtggtattgctattttggaactgatactaagcaaacagagctctgtaatgctatgaaaggtcagatgcctacttccagaattaaacataaatgtaatggtactgacctaatactactcaatatcacaaaagcatatgctggcagttattcctgccctgcggccaacactgaggatatgattttttacaaagtaactgttgttgatcccaccactccaccaccacccaccacaactactaaagctaccacacacacacagcaaaccacaccagataaggggtttgccttaaaagttcagcaagaaggcggggcttcttttggagctaagacccctactcctgatcctcactgtccagggccattagtcagcagcattgtcggtgtgctttgtggtttagcaattgtgatcatctgcttgttcatttttgcttgctgctacagaaggcttcaccgacaaaaatcagacccactgctgaacctctatgtttaattttaatttcagaaccatgaaggcacttatcactttagtttttctttctttaattggcactgtttttagtgttagttttttgaaaaaaatcaatgtcactgagggagataatgtgacattggttggtgtagaaggtgctgaaaataccacctggacaaaatatcacatggatgggtggaaagaaatttgcacctggaatgtcactacttatacatgtgagggagttaaccttaccattgtcaatgttagcgaaattcaaaagggttggattaaagggcagagtgttagtgtcaccagtgagggatattttacccaacatacttttatctatgacattattgtcataccactgcccacacctagcccacctagcactactcagaccacacaaacaacctacactacacagagctccacaactaccttgcaaaccactcagacaaccacttacactacatccactcagcccaccaccactacagcagaggcgagtagctcaccaaccatcaaagtggcatttttgttactgccaccatctagcagtcctgctagtaccaatgagcagactactgaatttttgtccactattcagagcagcaccacagctacctcgagtgccttctctagcaccgccaatctcacctcgctttcctctacgccaatcagtaatgctactacctccccagctcctcttcccactcctctgaagcaatcagagtctagcacgcagctgcagatcaccctgctcattgtgatcggggtggtcatcctggcagtgctgctctactttatcttctgccgccgcatccccaacgcgaagccggcctacaagcccattgttatcggcacgccggagccgcttcaggtggagggaggtctaaggaatcttctcttctcttttacagtatggtgatttgaactatgattcctagacatttcattatcacttctctaatctgtgtgctccaagtctgtgccaccctcgctctcgtggctaacgcgagtccagactgcattggagcgttcgcctcctacgtgctctttgccttcatcacctgcatctgctgctgtagcatagtctgcctgcttatcaccttcttccagttcgttgactgggtctttgtgcgcatcgcctacctgcgccaccatccccagtaccgcgaccagagagtggcgcaactgttgagactcatctgataagcatgcgggctctgctacttctcgcgcttgtgctagctcccctcgccgcccccttaaccctcaaatcccccacccagtcccctgaagaggttcgaaaatgtaaattccaagaaccctggaaattcctttcatgctacaaactcaaatcagaaatgcaccccagctggatcatgatcattggaatcgtgaacatccttgcctgtaccctcatctcctttgtgatttacccctgctttaactttgggtggaacgcacccgaggcgctctggctcccgcctgatcccgacacaccaccacagcagcagcaaaatcaggcacatgcaccaccacagcctaggccacaatacatgcccatcttagactatgaggccgagccacagcgagccatgcttcctgctattagttacttcaatctaaccggcggagatgactgaccccatggccaacaacaccgtcaacgacctc

SEQ ID NO: 189 - protein, 187 aa, Artificial Sequence; identical to SEQ ID NO: 22
  Synthetic Construct

SEQ ID NO: 190 - protein, 212 aa, Artificial Sequence; identical to SEQ ID NO: 14
  Synthetic Construct

SEQ ID NO: 191 - protein, 306 aa, Artificial Sequence; identical to SEQ ID NO: 24
  Synthetic Construct

SEQ ID NO: 192 - protein, 143 aa, Artificial Sequence; identical to SEQ ID NO: 18
  Synthetic Construct

SEQ ID NO: 193 - DNA, 38545 bp, Artificial Sequence
  Simian adenovirus A1325 clone
  misc_feature (5)..(12): Swa\I
  repeat_region (16)..(144): ITR
  misc_feature (447)..(472): I-Ceu\recognition site
  misc_feature (460)..(461): cleavage point for bottom strand
  misc_feature (464)..(465): cleavage point for top strand
  enhancer (814)..(1074): Enhancer
  misc_feature (1075)..(1302): CMV promoter
  TATA_signal (1276)..(1279): TATA
  CDS (1398)..(2489): Gag\short
  polyA_signal (2642)..(2844): BGH-PolyA
  misc_feature (2917)..(2955): PI-Scel recognition site
  misc_feature (2927)..(2928): cleavage point on bottom strand
  misc_feature (2931)..(2932): cleavage point on top strand
  CDS (2956)..(3345): E1b\55K
  CDS (3383)..(3853): pIX
  misc_feature (3919)..(5540): IVa2    complement (3919..5249,5528..5540)
  misc_feature (8384)..(13757): pTP    complement (8384..10309,13749..13757)
  CDS (10740)..(11915): 52K
  CDS (11942)..(13720): pIIIa
  CDS (13797)..(15422): penton
  CDS (15429)..(16010): pVII
  CDS (16058)..(17098): V
  CDS (17124)..(17354): pX
  CDS (17426)..(18151): pVI
  CDS (18191)..(21067): hexon
  misc_feature (19710)..(19710): n is a, c, g, or t
  misc_feature (19753)..(19753): n is a, c, g, or t
  CDS (21092)..(21712): protease
  misc_feature (21122)..(21122): n is a, c, g, or t
  misc_feature (21798)..(23330): DBP    complement (21798..23330)
  CDS (23356)..(25743): 100K
  CDS (26361)..(27041): pVIII
  CDS (27045)..(27362): E3\12.5K
  CDS (27930)..(28457): E3\gp19K
  CDS (28490)..(29107): E3\CR1-beta
  CDS (29123)..(29731): E3\CR1-gamma
  CDS (29749)..(30612): E3\CR1-delta
  CDS (30623)..(30895): E3\RID-alpha
  CDS (30904)..(31335): E3\RID-beta
  CDS (32032)..(33360): fiber
  misc_feature (33474)..(34627): E4\orf6/7    complement (33474..33725,34457..34627)
  misc_feature (33725)..(34627): E4\orf6    complement (33725..34627)
  misc_feature (34536)..(34898): E4\orf4    complement (34536..34898)
  misc_feature (34911)..(35261): E4\orf3    complement (34911..35261)
  misc_feature (35261)..(35647): E4\orf2    complement (35261..35647)
  misc_feature (35691)..(36062): E4\orf1    complement (35691..36062)
  misc_feature (36476)..(36483): Swa\I
  rep_origin (36721)..(36721): ORI
  misc_feature (37479)..(38342): AP(R)    complement (37479..38342)
aattatttaaatccccatcatcaataatatacctcaaacttttggtgcgcgttaatatgcaaatgaggtatttgaatttggggatgcggggcggtgattggctgcgggagcggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaattccgcgtttatggcagggaggagtatttgccgagggccgagtagactttgaccgattacgtgggggtttcgattaccgtatttttcacctaaatttccgcgtacgtaactataacggtcctaaggtagcgaaagctcagatctggatctcccgatcccctatggcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacagagagatgggtgcgagagcgtcagtattaagcgggggagaattagatcgatgggaaaaaattcggttaaggccagggggaaagaagaagtacaagctaaagcacatcgtatgggcaagcagggagctagaacgattcgcagttaatcctggcctgttagaaacatcagaaggctgtagacaaatactgggacagctacaaccatcccttcagacaggatcagaggagcttcgatcactatacaacacagtagcaaccctctattgtgtgcaccagcggatcgagatcaaggacaccaaggaagctttagacaagatagaggaagagcaaaacaagtccaagaagaaggcccagcaggcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaggacctgaacacgatgttgaacaccgtggggggacatcaagcagccatgcaaatgttaaaagagaccatcaatgaggaagctgcagattgggatagagtgcatccagtgcatgcagggcctattgcaccaggccagatgagagaaccaaggggaagtgacatagcaggaactactagtacccttcaggaacaaataggatggatgacaaataatccacctatcccagtaggagagatctacaagaggtggataatcctgggattgaacaagatcgtgaggatgtatagccctaccagcattctggacataagacaaggaccaaaggaaccctttagagactatgtagaccggttctataaaactctaagagctgagcaagcttcacaggaggtaaaaaattggatgacagaaaccttgttggtccaaaatgcgaacccagattgtaagaccatcctgaaggctctcggcccagcggctacactagaagaaatgatgacagcatgtcagggagtaggaggacccggccataaggcaagagttttgtagggatccactagttctagactcgagggggggcccggtacctttaagaccaatgacttacaaggcagctgtagatcttagccactttttaaaagaaaaggggggactggaagggctaattcactcccaaagaagacaagataaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcacatatgctggccaccgtgcatgtggcctcgcacccccgcaagacatggcccgagttcgagcacaacgtcatgacccgctgcaatgtgcacctgggctcccgccgaggcatgttcatgccataccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggtgggtgggagcctgcatgatgggcagaatgactaaaatctgtgtttttctgcgcagcagcatgagcggaagcgcctcctttgagggaggggtattcagcccttatctgacggggcgtctcccctcctgggctggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggtgccggctactacagctctctggtggccaactcgagttccgccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacaaaggtgccctcgatcccgggggcgtagttgccctcgcagatctgcatctcccaggccttgagctcggagggggggatcatgtccacctgcggggcgatgaaaaaaacggtttccggggcgggggagatgagctgcgccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagtccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggttcggtccttccagggccgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcggggcggtcggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagagcagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagatcgtccagcgccgcttgccagtcgcgcacggccagcgcgcgctcgtaggggctgaggggcgtgccccagggcatggggtgcgtgagcgcggaggcatacatgccgcagatgtcgtagacgtagaggggctcctctaggacgccgatgtaggtggggtagcagcgccccccgcggatgctggcgcgcacgtagtcgtacagctcgtgcgagggcgcgaggaggcccgtgccgaggttggagcgctgcggcttttcggcgcggtagacgatctggcggaagatggcgtgggagttggaggagatggtgggcctctggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcatacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaggcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgctgacccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctcgtgctgtactacgtcctggccatcggcgtggccatcgtctgcctcgatggtggtcatgctgacgagcccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgtttcttcttgggcgctgcttccatgtcggtcagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcggcggttgacgtcctggatctgacgcctctgggtgaaggccacgggacccgtgagtttgaacctgaaagagagttcgacagaatcaatttcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttaagcgtggtggcgatgtgctcggtgacgaagaagtacatgatccagcggcggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcactcgaaggcccccgggagttcctccacttcctcttcttccatctcctccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctgtatctgggtgagggtggtctggaagtcgtcaaagtcgacgaagcggtggtaggctccggtgttgatggtgtaggagcagttggccatgacggaccagttgacggtctggtgaccgggacgcacgagctcgtggtacttgaggcgcgagtaggcgcgcgtgtcgaagatgtagtcgttgcaggtgcgcaccaggtactgatagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggcctgaaaactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccctagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggccagacttctcagtatgaccacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcgccgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcaacatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccattaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccttatgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgttcagaccaacctggaccgcatggtgaccgacgtgcgcgaggccgtggcccagcgcgagcggttccaccgcgagtccaacctgggatccatggtggcgctgaatgccttcctcagcacccagcccgccaacgtgccccggggccaggaggactacaccaacttcatcagtgccctgcgcctgatggtgaccgaggtgccccagagcgaggtgtaccagtccgggccggactacttcttccagaccagtcgccagggcttgcagaccgtgaacctgagccaggctttcaagaacttgcagggattgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccaccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaagccgccagtcctttcccgagcttgcccttctcgctaaacagcattcgcagcagcgagctgggcaggatcacgcgcccgcgcttgctgggcgaggaggagtacttgaatgactcgctgttgagacccgagcgggagaagaacttccccaataacggaatagagagcctggtggacaagatgagccgctggaaaacgtatgcgcaggagcacagggacgatccccgggcgtcgcagggggccacgagccggggcagcgcggcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgtttagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaacggggtcaaagtagatgatgactatgatggtagtcaggatatcttggagtatgagtgggtggagtttgagctgcccgaaggcaacttctcggtgaccatgaccatcgacctgatgaacaacgccattatcgacaattacttggcggtggggcggcagaacggggtgctggagagcgacatcggcgtgaagttcgacacgcgcaacttcaggctcggttgggaccccgtgaccgagctggtcatgccgggcgtgtacaccaacgaggccttccaccccgacatcgtcctgctgcccggctgcggcgtggacttcaccgagagccgcctcagcaacctgctgggcatccgcaagcggcagcccttccaggagggtttccagatcatgtacgaggacctggaggggggcaacatccccgcgctgctggacgtcgaagcctacgagaaaagcaaggaggaggccgccgcagcggcgaccgcggccgtggctactgctgcgaccaccgatgcagatgcagctactactaccaggggcgatacattcgccacccaggcggaggaagcagccgccctagcggcgaccgatgatagtgaaagtaagatagtcatcaagccggtggagaaggacagcaaggacaggagctacaacgttctatcggatggaaagaacaccgcctaccgcagctggtacctggcctacaactacggcgaccctgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggcggcggtgaaggaggaaagaaagccccgcaaactgaagcgggtcaaaaaggacaaaaaggaggaggaagatgacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggccgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagactgagcccgtgaagcccagcaccagcaccatggaggtgcagacggatccctggatgccggcgccggcttccaccaccaccacccgccgaagacgcaagtacggcgcggccagcctgctgatgcccaactacgcgctgcatccttccatcatccccacgccgggctaccgcggcacgcgcttctaccgcggctacaccagcagccgccgccgcaagaccaccacccgccgccgccgtcgtcgcagccgccgcagcagcaccgcgacttccgccttggtgcggagagtgtaccgcagcgggcgcgagcctctgaccctgccgcgcgcgcgctaccacccgagcatcgccatttaactaccgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgctgggtccgtggacatgccccaggtggaggaggagctgcctcccctggacaagcgcggcgacaagcgaccgcgtcccgacgctgaggagacgctgctgacgcacacggacgagccgcccccgtacgaggaggcggtgaaactgggtctgcccaccacgcggcccgtggcgcctctggccaccggggtgctgaaacccagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatgtatgtccgccgaccagaaggaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggtgacaaccgcgtgctggacatggccagcacctactttgacatccgcggcgtgctggatcggggccccagcttcaaaccctactccggcaccgcctacaacgctctggctcccaaagctgctcctaatcctagtcagtggtatgaaaccaccgagggaacaaatggaaacgctgacgccactactactaaacatagttttggtttggctgccatgaagggcgataatattgcagctgaaggactgcaaataggaacagattctacctctggatctgatacacccatctatgcagataaactgtatcagccagagcctcagataggagaggaatcatggacagacaacgatggaaccaatgaaaaattcggtggaagagttcttaaacctgacaccaacatgaaaccctgctatggctcatttgccaaacccactaataacaaaggtggtcaagcaaaacaaaaggcaacggaaggaacagctgtggattatgatgttgacatgaactttttcgatggtagagatgcagctgctaactttactccagaagtagtgttgtatgctgaaaatgtggatttggaaactccagacacccatattgtatacaaaccaggaacttcagatttgagttcccatgtgaatttgggtcaacagtccatgcccaacagacccaactacattggattcagagataactttatcgggcttatgtactacaacagcactggcaatatgggtgtactggctggtcaggcctcccagctgaatgctgtggtggacttgcaggacagaaacaccgaactgtcctaccagctcttgcttgactctctgggtgacagaaccaggtatttcagtatgtggaatcaggcggtggacagttatgaccccgatgtgcgcattattgaaaaccatggtatagaagatgaacttcccaactactgtttcccaattgatgctgtgggcatcaccagaacctatcaaggcataaaagtacaaaatggaactggcactggaacgacatgggaaaaagatactgatgttagtacagccaacgaaataggaattggcaacaatctggccatggagatcaacatccaggccaacctgtggcggaacttcctctacgcgaacgtggcgctgtacctgcccgactcctacaagtacacgccggccaacatcacgctgcccaccaacaccaacanctacgattacatgaacggccgcgtggtggcgccctcgctggtngacgcctacatcaacatcggggcgcgctggtcgctggaccccatggacaacgtcaatcccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggatggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgaccgggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagccgctcttgcttcttgcaagatgacggcctgtggctccggcgagcaggagntcagggccatcctccgcgacctgggctgcgggccctgcttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcagacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaagcgctctaccgcttcctcaacgcccactccgcctactttcgctcccaccgcgcgcgcatcgagaaggccaccgccttcgaccgcatgaatcaagacatgtaaaccgtgtgtatgtgaatgctttattcatcataataaacagcacatgtttatgccaccttctctgaggctctgactttatttagaaatcgaaggggttctgccggctctcggcgtgccccgcgggcagggatacgttgcggaactggtacttggacagccacttgaactcggggatcagcagcttgggcacggggaggtcggggaacgagtcgctccacagcttgcgcgtgagttgcagggcgcccagcaggtcgggcgcggagatcttgaaatcgcagttgggacccgcgttctgcgcgcgagagttacggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccacaggacttgctagagaactggttggtggcgcagcccgcgtcgtgcacgcagcagcgcgcgtcgttgttggccagctgcaccacgctgcgcccccagcggttctgggtgatcttggcccggtcggggttctccttcagcgcgcgctgcccattctcgctcgccacatccatctcgatcgtgtgctccttctggatcatcacggtcccgtgcaggcaccgcagcttgccctcggcctcggtgcacccgtgcagccacagcgcgcagccggtgctctcccagttcttgtgggcgatctgggagtgcgagtgcacgaagccctgcaggaagcggcccatcatcgtggtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgtcatcttagtcgccgccgccgaggtcagggggtcgttctcgtccagggtctcaaacactcgcttgccgtccttctcggtgatgcgcacgggggggaaggcgaagcccacggccgccagctcctcctcggcctgcctttcgtcctcgctgtcctggctgatgtcttgcaaaggcacatgcttggtcttgcggggtttctttttgggtggcagaggcggcggcggagacgtgctgggcgagcgcgagttttcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattatgttctcctagggagcaacaagcatggagactcagccatcgtcgccaacatcgccatctgcccccgccgacgagaaccagcagcagaatgaaagcttaaccgccccgccgcccagccccacctccgacgccgcagccccagacatgcaagagatggagaaatccatcgagattgacctgggctacgtgacgcccgcggagcacgaggaggagctggcagcgcgcttttcagccccggaagagaaccaccaagagcagccagagcaggaagcagagagcgagcagcagcaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgccctgctcaacctgggtcccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctgaaggccctgtggaccgggttcgacgagcgcaccaccgccgcggacctggccgacctcattttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacttgctgcgcctggccaactacctggcctaccactcggacgtgatcgaggacgtcagcggcgagggtctgctcgagtgccactgtcgctgcaacctctgcacgccgcaccgctccctggcctgcaacccccagctgctgagcgagacccagatcatcggcaccttcgagttgcaaggccccggcgaggagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccgccggaggatttggaggaagactgggagagcagtcaggcagaggagatggaagactgggacagcactcaggcagaggaggacagcctgcaagacagtctggaggaggaagacgaggtggaggaggaggcagaggaagaagcagccgccgccagaccgtcgtcctcggcggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagaaaaccagcggcagctagaaaatccacagcggcggcaggtggactgaggatcgcggcgaacgagccggcgcagacccgggagctgaggaatcggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatcctcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcggctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggcctcgactcccacctgcttcggatcttcagccagcgaccgatcctggtcgagcgcgagcaaggacagacccgtctgaccctgtactgcatctgcaaccaccccggcctgcatgaaagtctttgttgtctgctgtgtactgagtataataaaagctgagatcagcgactactccggactcgattgtggtgttcctgctatcaaccggtccctgttcttcaccgggaacgagaccgagctccagctccagtgtaagccccacaagaagtatctcacctggctgttccagggctccccgatcgccgttgtcaaccactgcgacaacgacggagtcctgctgagcggccccgccaaccttactttttccacccgcagaagcaagctccagctcttccaacccttcctccccgggacctatcagtgcctctcgggaccctgccatcacaccttccacctgatcccgaataccacagcggcgctccccgctactaacaaccaaactacccaccaacgccaccgtcgcgacctttcctctgaatctaatactaccacccacaccggaggtgagctccgaggtcaaccaacctctgggatttactacggcccctgggaggtggtggggttaatagcgctaggcctagttgcgggtgggcttttggctctctgctacctatacctcccttgctgttcttacttagtggtgctgtgttgctggtttaagaaatggggaagatcaccctagtgagctgcggtgcgctggtggcggtggtgctttcgattgtgggactgggcggcgcggctgtagtgaaggagaaggccgatccctgcttgcatttcaatcccgacaaatgccagctgagttttcagcccgatggcaatcggtgcgcggtgctgatcaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaacaatactttcatttttgcacacatgtgcgacacggtcatgtggatgagcaagcagtacgatatgtggccccccacgaaggagaacatcgtggtcttctccatcgcttacagcctgtgcacggcgctaatcaccgctatcgtgtgcctgagcattcacatgctcatcgctattcgccccagaaataatgccgaaaaagagaaacagccataacacgttttttcacacacctttttcagaccatggcctctgttaaattttttgctttatttgccagtctcattaccgtcattcatggaatgagtaatgagaaaattactatttacactggcactaatcacacattgaaaggtccagaaaaatccacagaagtttcatggtattgttattttaatgaatcagatgtagctactgaactctgtggaaacaacaacaaaaaaaatgagagcattactctcatcaagtttcaatgtggatctgacttaaccctcattaacatcactagagactatgtaggtatgtattatggaactacagcaggcatttcggacatggaattttatcaagtttctgtgtctgaacccaccacgcctagaatgaccacaaccacaaaaactacacctactaccaccacacagctcactaccaatggcttttttgccatgcttcaagtggctgaaaatagcaccagcattcaacccaccccacccagtgaggaaattcccaaatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctatgccttttagttttttatatcattacctctgctctttgtgaatcagtggataaagatgttactattaccactggttctaattatacactgaaaggaccaccctcaggtatgctttcgtggtattgctattttggaactgacactgatcaaactgaattatgcaattttcaaaaaggcaaaacctcaaactctaaaatctctaattatcaatgcaatggcactgatctgatactactcaatgtcacgaaagcatatggtggcagttattcatgccctggacaaaacactgaagaaatgattttttacaaagtggaagtggttgatcccactactccacctccacccgccacaactactcacaccacacacacagaacaaagcacagcagaggcagcaaagttagccttgcaggtccaagacagttcatttgttggcattacccctacacctgatcagcggtgtccggggctgctcgtcagcggcattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcgctctagttttttgttctttgattggcattgtttttaatagtaaaattaccagagttagctttattaaacatgttaatgtaactgaaggagataacatcacactagcaggtgtagaaggtgctcaaaacaccacctggacaaaataccatctaggatggagagatatttgcacctggaatgtaacttattattgcataggagttaatcttaccattgttaacgctaaccaatctcagaatgggttaattaaaggacagagtgttagtgtgaccagtgatgggtactatacccagcatagttttaactacaacattactgtcataccactgcctacgcctagcccacctagcactaccgcacagacaaccacatacagtacatcaaatcagcctaccaccactacagcagcagaggttgccagctcgtctggggtccgagtggcatttttgatgttggccccatctagcagtcccactgctagtaccaatgagcagactactgaatttttgtccactgtcgagagccacaccacagctacctccagtgccttctctagcaccgccaatctctcctcgctttcctctacaccaatcagtcccgctactactcctagccccgctcctcttcccactcccctgaagcaaacagacggcggcatgcaatggcagatcaccctgctcattgtgatcgggttggtcatcctggccgtgttgctatactacatcttctgccgccgcattcccaacgcgcaccgcaagccggcctacaagcccatcgttatcgggcagccggagccgcttcaggtggaagggggtctaaggaatcttctcttctcttttacagtatggtgattgaattatgattcctagacaattcttgatcactattcttatctgcctcctccaagtctgtgccaccctcgctctggtggccaacgccagtccagactgtattgggcccttcgcctcctacgtgctctttgccttcatcacctgcatctgctgctgtagcatagtctgcctgcttatcaccttcttccagttcattgactggatctttgtgcgcatcgcctacctgcgccaccacccccagtaccgcgaccagcgagtggcgcggctgctcaggctcctctgataagcatgcgggctctgctacttctcgcgcttctgctgttagtgctcccccgtcccgtcgacccccggacccccacccagtcccccgaggaggtccgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcaacctcaggcacacgcactaccaccaccaccacagcctaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgattaaataaaaaaaataatcatttgatttgaaataaagatacaatcatattgatgatttgagtttaataaaaataaagaatcacttacttgaaatctgataccaggtctctgtccatgttttctgccaacaccacttcactcccctcttcccagctctggtactgcaggccccggcgggctgcaaacttcctccacaccctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgactcctcgggaaaactcatctccaacacggccaccaaggccgccgcccctctcagtttttccaacaacaccatttcccttaacatggatacccctctttataccaaagatggaaaattatccttacaagtttctccaccattaaacatattaaaatcaaccattctgaacactttagctgtagcttatggatcaggtttaggactcagtggtggcactgctcttgcagtacagttggcctctccactcacctttgatgaaaaaggaaatattaaaattaacctagccagtggtccattaacagttgatgcaagtcgacttagtatcaactgcaaaagaggggttactgtcactaccgcaggagatgcaattgaaagcaacataagctggcctaaaggtataagatttgaaggtgatgccatagctgcaaacattggcagaggattggaatttggaaccactagtacagagactgatgtcacagatgcatacccaattcaagttaaattgggtactggtctcacctttgacagtacaggcgccattgttgcatggaacaaagaggatgataaacttacattatggaccacagccgacccctcgccaaattgcaaaatatactctgaaaaagatgctaaactcacactttgcttgacaaaatgtggaagccaaattctgggcactgtgactgtattggcagtgaataatggaagtctcaacccaattacaaacacagtaagcactgcacttgtctccctcaagtttgatgcaagtggagttttgctaagcagctccacattagacaaagaatattggaacttccgaaagggagatgttacacctgctgaaccctatactaatgctataggttttatgcctaacataaaggcctatcctaaaaacacatctgcagcttcaaaaagccatattgtcagtcaagtttatctcaatggggatgaaaccaaacctctgatgctgattattacttttaatgaaactgaggatgcaacttgcacctacagtatcacttttcaatggaaatgggatagtactaagtacacaggtaaaacacttgctaccagctccttcaccttctcctacattgcccaagaatgaatactgtattccaccctgcatgccaacccttcccaccccactctgtctatggaaaaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggcgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgtcgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgccccctccagaacacgctgcccatgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccgacaatggcaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtcccggcgcttggaacgctcggtgttgaagttgtaaaacagccactctctcagaccgtgcagcagatctagggcctcaggagtgatgaagatcccatcatgcctgatggctctaatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaagatcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctaagctcctccctcagcaataactgtaagtactctttcatatcctctccgaaatttttagccataggaccgccaggaatgagattaggacaagccacattacagataaaccgaagtcccccccagtgagcattgccaaatgtaagattgaaataagcatgctggctagacccggtgatatcttccagataactggacagaaaatcgcccaggcaatttttaagaaaatcaacaaaagaaaaatcttccaggtgcacgtttagggcctcgggaacaacgatggagtaagtgcaaggggtgcgttccagcatggttagttagctgatctgtaaaaaaacaaaaaataaaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgacaagatgaatacacccccggaacattggcgtccgcgagtgaaaaaaagcggccgaggaagcaataaggcactacaatgctcagtctcaagtccagcaaagcgatgccatgcggatgaagcacaaaattctcaggtgcgtacaaaatgtaattactcccctcctgcacaggcagcaaagccccagatccctccagatacacatacaaagcctcagcgtccatagcttaccgagcagcagcacacaacaggcgcaagagtcagagaaaggctgagctctaacctgtcccccgctctctgctcaatatatagcccagatctacactgacgtaaaggccaaagtctaaaaatacccgccaaataatcacacacgcccagcacacgcccagaaaccggtgacacactcaaaaaaatacgcgcacttcctcaaacgcccaaactgccgtcatttccgggttcccacgctacgtcatcagaattcgactttcaaatccgtcgaccgttaaacacgtcactcgccccgcccctaacggtcgccctcctctcggccaatcacagccccgcatccccaaattcaaacgcctcatttgcatattaacgcgcacaaaaagtttgaggtatattattgatgatgatcatttaaatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaag

SEQ ID NO: 194 - protein, 363 aa, Artificial Sequence; identical to SEQ ID NO: 169
  Synthetic Construct

SEQ ID NO: 195 - protein, 130 aa, Artificial Sequence
  Synthetic Construct
HMLATVHVASHPRKTWPEFEHNVMTRCNVHLGSRRGMFMPYQCNMQFVKVLLEPDAMSRVSLTGVFDMNVELWKILRYDESKTRCRACECGGKHARLQPVCVEVTEDLRPDHLVLSCNGTEFGSSGEESD

SEQ ID NO: 196 - protein, 157 aa, Artificial Sequence; identical to SEQ ID NO: 30
  Synthetic Construct

SEQ ID NO: 197 - protein, 392 aa, Artificial Sequence; identical to SEQ ID NO: 31
  Synthetic Construct

SEQ ID NO: 198 - protein, 593 aa, Artificial Sequence; identical to SEQ ID NO: 32
  Synthetic Construct

SEQ ID NO: 199 - protein, 542 aa, Artificial Sequence; identical to SEQ ID NO: 33
  Synthetic Construct

SEQ ID NO: 200 - protein, 194 aa, Artificial Sequence; identical to SEQ ID NO: 34
  Synthetic Construct

SEQ ID NO: 201 - protein, 347 aa, Artificial Sequence; identical to SEQ ID NO: 35
  Synthetic Construct

SEQ ID NO: 202 - protein, 77 aa, Artificial Sequence; identical to SEQ ID NO: 36
  Synthetic Construct

SEQ ID NO: 203 - protein, 242 aa, Artificial Sequence; identical to SEQ ID NO: 37
  Synthetic Construct

SEQ ID NO: 204 - protein, 959 aa, Artificial Sequence
  misc_feature (507)..(507): The 'Xaa' at location 507 stands for Asn, Ser, Thr, or Ile.
  Synthetic Construct
MYVRRPEGGGRGASPSCKMATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNALAPKAAPNPSQWYETTEGTNGNADATTTKHSFGLAAMKGDNIAAEGLQIGTDSTSGSDTPIYADKLYQPEPQIGEESWTDNDGTNEKFGGRVLKPDTNMKPCYGSFAKPTNNKGGQAKQKATEGTAVDYDVDMNFFDGRDAAANFTPEVVLYAENVDLETPDTHIVYKPGTSDLSSHVNLGQQSMPNRPNYIGFRDNFIGLMYYNSTGNMGVLAGQASQLNAVVDLQDRNTELSYQLLLDSLGDRTRYFSMWNQAVDSYDPDVRIIENHGIEDELPNYCFPIDAVGITRTYQGIKVQNGTGTGTTWEKDTDVSTANEIGIGNNLAMEINIQANLWRNFLYANVALYLPDSYKYTPANITLPTNTNXYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 205 - protein, 207 aa, Artificial Sequence
  misc_feature (11)..(11): The 'Xaa' at location 11 stands for Ile, Val, Leu, or Phe.
  Synthetic Construct
MTACGSGEQEXRAILRDLGCGPCFLGTFDKRFPGFMAPHKLACAIVNTAGRETGGEHWLAFAWNPRSHTCYLFDPFGFSDERLKQIYQFEYEGLLRRSALATEDRCVTLEKSTQTVQGPRSAACGLFCCMFLHAFVHWPDRPMDKNPTMNLLTGVPNGMLQSPQVEPTLRRNQEALYRFLNAHSAYFRSHRARIEKATAFDRMNQDM

SEQ ID NO: 206 - protein, 796 aa, Artificial Sequence; identical to SEQ ID NO: 40
  Synthetic Construct

SEQ ID NO: 207 - protein, 227 aa, Artificial Sequence; identical to SEQ ID NO: 41
  Synthetic Construct

SEQ ID NO: 208 - protein, 106 aa, Artificial Sequence; identical to SEQ ID NO: 42
  Synthetic Construct

SEQ ID NO: 209 - protein, 176 aa, Artificial Sequence; identical to SEQ ID NO: 43
  Synthetic Construct

SEQ ID NO: 210 - protein, 206 aa, Artificial Sequence; identical to SEQ ID NO: 44
  Synthetic Construct

SEQ ID NO: 211 - protein, 203 aa, Artificial Sequence; identical to SEQ ID NO: 45
  Synthetic Construct

SEQ ID NO: 212 - protein, 288 aa, Artificial Sequence; identical to SEQ ID NO: 46
  Synthetic Construct

SEQ ID NO: 213 - protein, 91 aa, Artificial Sequence; identical to SEQ ID NO: 47
  Synthetic Construct

SEQ ID NO: 214 - protein, 144 aa, Artificial Sequence; identical to SEQ ID NO: 48
  Synthetic Construct

SEQ ID NO: 215 - protein, 443 aa, Artificial Sequence; identical to SEQ ID NO: 49
  Synthetic Construct

SEQ ID NO: 216 - DNA, 31740 bp, Artificial Sequence
  Simian adenovirus A1325 clone
  misc_feature (19710)..(19710): n is a, c, g, or t
  misc_feature (19753)..(19753): n is a, c, g, or t
  misc_feature (21122)..(21122): n is a, c, g, or t
  CDS (25463)..(26023): 22K
  CDS (27319)..(27945): E3\CR1-alpha
  CDS (31331)..(31735): E3\14.7K
aattatttaaatccccatcatcaataatatacctcaaacttttggtgcgcgttaatatgcaaatgaggtatttgaatttggggatgcggggcggtgattggctgcgggagcggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaattccgcgtttatggcagggaggagtatttgccgagggccgagtagactttgaccgattacgtgggggtttcgattaccgtatttttcacctaaatttccgcgtacgtaactataacggtcctaaggtagcgaaagctcagatctggatctcccgatcccctatggcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacagagagatgggtgcgagagcgtcagtattaagcgggggagaattagatcgatgggaaaaaattcggttaaggccagggggaaagaagaagtacaagctaaagcacatcgtatgggcaagcagggagctagaacgattcgcagttaatcctggcctgttagaaacatcagaaggctgtagacaaatactgggacagctacaaccatcccttcagacaggatcagaggagcttcgatcactatacaacacagtagcaaccctctattgtgtgcaccagcggatcgagatcaaggacaccaaggaagctttagacaagatagaggaagagcaaaacaagtccaagaagaaggcccagcaggcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaggacctgaacacgatgttgaacaccgtggggggacatcaagcagccatgcaaatgttaaaagagaccatcaatgaggaagctgcagattgggatagagtgcatccagtgcatgcagggcctattgcaccaggccagatgagagaaccaaggggaagtgacatagcaggaactactagtacccttcaggaacaaataggatggatgacaaataatccacctatcccagtaggagagatctacaagaggtggataatcctgggattgaacaagatcgtgaggatgtatagccctaccagcattctggacataagacaaggaccaaaggaaccctttagagactatgtagaccggttctataaaactctaagagctgagcaagcttcacaggaggtaaaaaattggatgacagaaaccttgttggtccaaaatgcgaacccagattgtaagaccatcctgaaggctctcggcccagcggctacactagaagaaatgatgacagcatgtcagggagtaggaggacccggccataaggcaagagttttgtagggatccactagttctagactcgagggggggcccggtacctttaagaccaatgacttacaaggcagctgtagatcttagccactttttaaaagaaaaggggggactggaagggctaattcactcccaaagaagacaagataaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcacatatgctggccaccgtgcatgtggcctcgcacccccgcaagacatggcccgagttcgagcacaacgtcatgacccgctgcaatgtgcacctgggctcccgccgaggcatgttcatgccataccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggtgggtgggagcctgcatgatgggcagaatgactaaaatctgtgtttttctgcgcagcagcatgagcggaagcgcctcctttgagggaggggtattcagcccttatctgacggggcgtctcccctcctgggctggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggtgccggctactacagctctctggtggccaactcgagttccgccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacaaaggtgccctcgatcccgggggcgtagttgccctcgcagatctgcatctcccaggccttgagctcggagggggggatcatgtccacctgcggggcgatgaaaaaaacggtttccggggcgggggagatgagctgcgccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagtccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggttcggtccttccagggccgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcggggcggtcggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagagcagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagatcgtccagcgccgcttgccagtcgcgcacggccagcgcgcgctcgtaggggctgaggggcgtgccccagggcatggggtgcgtgagcgcggaggcatacatgccgcagatgtcgtagacgtagaggggctcctctaggacgccgatgtaggtggggtagcagcgccccccgcggatgctggcgcgcacgtagtcgtacagctcgtgcgagggcgcgaggaggcccgtgccgaggttggagcgctgcggcttttcggcgcggtagacgatctggcggaagatggcgtgggagttggaggagatggtgggcctctggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcatacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaggcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgctgacccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctcgtgctgtactacgtcctggccatcggcgtggccatcgtctgcctcgatggtggtcatgctgacgagcccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgtttcttcttgggcgctgcttccatgtcggtcagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcggcggttgacgtcctggatctgacgcctctgggtgaaggccacgggacccgtgagtttgaacctgaaagagagttcgacagaatcaatttcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttaagcgtggtggcgatgtgctcggtgacgaagaagtacatgatccagcggcggagcggcatctcgctgacgtcgcccagcgcctccaagcgttccatggcctcgtaaaagtccacggcgaagttgaaaaactgggagttgcgcgccgagacggtcaactcctcctccagaagacggatgagctcggcgatggtggcgcgcacctcgcactcgaaggcccccgggagttcctccacttcctcttcttccatctcctccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctgtatctgggtgagggtggtctggaagtcgtcaaagtcgacgaagcggtggtaggctccggtgttgatggtgtaggagcagttggccatgacggaccagttgacggtctggtgaccgggacgcacgagctcgtggtacttgaggcgcgagtaggcgcgcgtgtcgaagatgtagtcgttgcaggtgcgcaccaggtactgatagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggcctgaaaactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagaccccctagccagccgacttctccagttacggagcgagcccctcttttgttttgtttgtttttgccagatgcatcccgtactgcggcagatgcgcccccaccaccctccaccgcaacaacagccccctccacagccggcgcttctgcccccgccccagcagcaacttccagccacgaccgccgcggccgccgtgagcggggctggccagacttctcagtatgaccacctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcgccgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcaacatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccattaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcggcaggaccttatgtagaagaggtggacgatgaggtggacgaggagggcgagtacctggaagactgatggcgcgaccgtatttttgctagatgcaacaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgttcagaccaacctggaccgcatggtgaccgacgtgcgcgaggccgtggcccagcgcgagcggttccaccgcgagtccaacctgggatccatggtggcgctgaatgccttcctcagcacccagcccgccaacgtgccccggggccaggaggactacaccaacttcatcagtgccctgcgcctgatggtgaccgaggtgccccagagcgaggtgtaccagtccgggccggactacttcttccagaccagtcgccagggcttgcagaccgtgaacctgagccaggctttcaagaacttgcagggattgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataaactgatggactacttgcatcgggcggccgccatgaactctgactatttcaccaacgccatcctgaatccccactggctcccgccaccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgacgcccgtcctcggcgctgtccggccgcgagggtgctgccgcggcggtgcccgaagccgccagtcctttcccgagcttgcccttctcgctaaacagcattcgcagcagcgagctgggcaggatcacgcgcccgcgcttgctgggcgaggaggagtacttgaatgactcgctgttgagacccgagcgggagaagaacttccccaataacggaatagagagcctggtggacaagatgagccgctggaaaacgtatgcgcaggagcacagggacgatccccgggcgtcgcagggggccacgagccggggcagcgcggcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgtttagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcccgcaagacccccaacggggtcaaagtagatgatgactatgatggtagtcaggatatcttggagtatgagtgggtggagtttgagctgcccgaaggcaacttctcggtgaccatgaccatcgacctgatgaacaacgccattatcgacaattacttggcggtggggcggcagaacggggtgctggagagcgacatcggcgtgaagttcgacacgcgcaacttcaggctcggttgggaccccgtgaccgagctggtcatgccgggcgtgtacaccaacgaggccttccaccccgacatcgtcctgctgcccggctgcggcgtggacttcaccgagagccgcctcagcaacctgctgggcatccgcaagcggcagcccttccaggagggtttccagatcatgtacgaggacctggaggggggcaacatccccgcgctgctggacgtcgaagcctacgagaaaagcaaggaggaggccgccgcagcggcgaccgcggccgtggctactgctgcgaccaccgatgcagatgcagctactactaccaggggcgatacattcgccacccaggcggaggaagcagccgccctagcggcgaccgatgatagtgaaagtaagatagtcatcaagccggtggagaaggacagcaaggacaggagctacaacgttctatcggatggaaagaacaccgcctaccgcagctggtacctggcctacaactacggcgaccctgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggcggcggtgaaggaggaaagaaagccccgcaaactgaagcgggtcaaaaaggacaaaaaggaggaggaagatgacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggccgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagactgagcccgtgaagcccagcaccagcaccatggaggtgcagacggatccctggatgccggcgccggcttccaccaccaccacccgccgaagacgcaagtacggcgcggccagcctgctgatgcccaactacgcgctgcatccttccatcatccccacgccgggctaccgcggcacgcgcttctaccgcggctacaccagcagccgccgccgcaagaccaccacccgccgccgccgtcgtcgcagccgccgcagcagcaccgcgacttccgccttggtgcggagagtgtaccgcagcgggcgcgagcctctgaccctgccgcgcgcgcgctaccacccgagcatcgccatttaactaccgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgctgggtccgtggacatgccccaggtggaggaggagctgcctcccctggacaagcgcggcgacaagcgaccgcgtcccgacgctgaggagacgctgctgacgcacacggacgagccgcccccgtacgaggaggcggtgaaactgggtctgcccaccacgcggcccgtggcgcctctggccaccggggtgctgaaacccagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatgtatgtccgccgaccagaaggaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggtgacaaccgcgtgctggacatggccagcacctactttgacatccgcggcgtgctggatcggggccccagcttcaaaccctactccggcaccgcctacaacgctctggctcccaaagctgctcctaatcctagtcagtggtatgaaaccaccgagggaacaaatggaaacgctgacgccactactactaaacatagttttggtttggctgccatgaagggcgataatattgcagctgaaggactgcaaataggaacagattctacctctggatctgatacacccatctatgcagataaactgtatcagccagagcctcagataggagaggaatcatggacagacaacgatggaaccaatgaaaaattcggtggaagagttcttaaacctgacaccaacatgaaaccctgctatggctcatttgccaaacccactaataacaaaggtggtcaagcaaaacaaaaggcaacggaaggaacagctgtggattatgatgttgacatgaactttttcgatggtagagatgcagctgctaactttactccagaagtagtgttgtatgctgaaaatgtggatttggaaactccagacacccatattgtatacaaaccaggaacttcagatttgagttcccatgtgaatttgggtcaacagtccatgcccaacagacccaactacattggattcagagataactttatcgggcttatgtactacaacagcactggcaatatgggtgtactggctggtcaggcctcccagctgaatgctgtggtggacttgcaggacagaaacaccgaactgtcctaccagctcttgcttgactctctgggtgacagaaccaggtatttcagtatgtggaatcaggcggtggacagttatgaccccgatgtgcgcattattgaaaaccatggtatagaagatgaacttcccaactactgtttcccaattgatgctgtgggcatcaccagaacctatcaaggcataaaagtacaaaatggaactggcactggaacgacatgggaaaaagatactgatgttagtacagccaacgaaataggaattggcaacaatctggccatggagatcaacatccaggccaacctgtggcggaacttcctctacgcgaacgtggcgctgtacctgcccgactcctacaagtacacgccggccaacatcacgctgcccaccaacaccaacanctacgattacatgaacggccgcgtggtggcgccctcgctggtngacgcctacatcaacatcggggcgcgctggtcgctggaccccatggacaacgtcaatcccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggatggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcaccagcgtcacccagaaaaagttcctctgcgaccgggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagccgctcttgcttcttgcaagatgacggcctgtggctccggcgagcaggagntcagggccatcctccgcgacctgggctgcgggccctgcttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcagacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaagcgctctaccgcttcctcaacgcccactccgcctactttcgctcccaccgcgcgcgcatcgagaaggccaccgccttcgaccgcatgaatcaagacatgtaaaccgtgtgtatgtgaatgctttattcatcataataaacagcacatgtttatgccaccttctctgaggctctgactttatttagaaatcgaaggggttctgccggctctcggcgtgccccgcgggcagggatacgttgcggaactggtacttggacagccacttgaactcggggatcagcagcttgggcacggggaggtcggggaacgagtcgctccacagcttgcgcgtgagttgcagggcgcccagcaggtcgggcgcggagatcttgaaatcgcagttgggacccgcgttctgcgcgcgagagttacggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccacaggacttgctagagaactggttggtggcgcagcccgcgtcgtgcacgcagcagcgcgcgtcgttgttggccagctgcaccacgctgcgcccccagcggttctgggtgatcttggcccggtcggggttctccttcagcgcgcgctgcccattctcgctcgccacatccatctcgatcgtgtgctccttctggatcatcacggtcccgtgcaggcaccgcagcttgccctcggcctcggtgcacccgtgcagccacagcgcgcagccggtgctctcccagttcttgtgggcgatctgggagtgcgagtgcacgaagccctgcaggaagcggcccatcatcgtggtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgtcatcttagtcgccgccgccgaggtcagggggtcgttctcgtccagggtctcaaacactcgcttgccgtccttctcggtgatgcgcacgggggggaaggcgaagcccacggccgccagctcctcctcggcctgcctttcgtcctcgctgtcctggctgatgtcttgcaaaggcacatgcttggtcttgcggggtttctttttgggtggcagaggcggcggcggagacgtgctgggcgagcgcgagttttcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattatgttctcctagggagcaacaagcatggagactcagccatcgtcgccaacatcgccatctgcccccgccgacgagaaccagcagcagaatgaaagcttaaccgccccgccgcccagccccacctccgacgccgcagccccagacatgcaagagatggagaaatccatcgagattgacctgggctacgtgacgcccgcggagcacgaggaggagctggcagcgcgcttttcagccccggaagagaaccaccaagagcagccagagcaggaagcagagagcgagcagcagcaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgccctgctcaacctgggtcccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctgaaggccctgtggaccgggttcgacgagcgcaccaccgccgcggacctggccgacctcattttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacttgctgcgcctggccaactacctggcctaccactcggacgtgatcgaggacgtcagcggcgagggtctgctcgagtgccactgtcgctgcaacctctgcacgccgcaccgctccctggcctgcaacccccagctgctgagcgagacccagatcatcggcaccttcgagttgcaaggccccggcgaggagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccgccggaggatttggaggaagactgggagagcagtcaggcagaggagatggaagactgggacagcactcaggcagaggaggacagcctgcaagacagtctggaggaggaagacgaggtggaggaggaggcagaggaagaagcagccgccgccagaccgtcgtcctcggcggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagaaaaccagcggcagctagaaaatccacagcggcggcaggtggactgaggatcgcggcgaacgagccggcgcagacccgggagctgaggaatcggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatcctcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcggctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggcctcgactcccacctgcttcggatcttcagccagcgaccgatcctggtcgagcgcgagcaaggacagacccgtctgaccctgtactgcatctgcaaccaccccggcctgcatgaaagtctttgttgtctgctgtgtactgagtataataaaagctgagatcagcgactactccggactcgattgtggtgttcctgctatcaaccggtccctgttcttcaccgggaacgagaccgagctccagctccagtgtaagccccacaagaagtatctcacctggctgttccagggctccccgatcgccgttgtcaaccactgcgacaacgacggagtcctgctgagcggccccgccaaccttactttttccacccgcagaagcaagctccagctcttccaacccttcctccccgggacctatcagtgcctctcgggaccctgccatcacaccttccacctgatcccgaataccacagcggcgctccccgctactaacaaccaaactacccaccaacgccaccgtcgcgacctttcctctgaatctaatactaccacccacaccggaggtgagctccgaggtcaaccaacctctgggatttactacggcccctgggaggtggtggggttaatagcgctaggcctagttgcgggtgggcttttggctctctgctacctatacctcccttgctgttcttacttagtggtgctgtgttgctggtttaagaaatggggaagatcaccctagtgagctgcggtgcgctggtggcggtggtgctttcgattgtgggactgggcggcgcggctgtagtgaaggagaaggccgatccctgcttgcatttcaatcccgacaaatgccagctgagttttcagcccgatggcaatcggtgcgcggtgctgatcaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaacaatactttcatttttgcacacatgtgcgacacggtcatgtggatgagcaagcagtacgatatgtggccccccacgaaggagaacatcgtggtcttctccatcgcttacagcctgtgcacggcgctaatcaccgctatcgtgtgcctgagcattcacatgctcatcgctattcgccccagaaataatgccgaaaaagagaaacagccataacacgttttttcacacacctttttcagaccatggcctctgttaaattttttgctttatttgccagtctcattaccgtcattcatggaatgagtaatgagaaaattactatttacactggcactaatcacacattgaaaggtccagaaaaatccacagaagtttcatggtattgttattttaatgaatcagatgtagctactgaactctgtggaaacaacaacaaaaaaaatgagagcattactctcatcaagtttcaatgtggatctgacttaaccctcattaacatcactagagactatgtaggtatgtattatggaactacagcaggcatttcggacatggaattttatcaagtttctgtgtctgaacccaccacgcctagaatgaccacaaccacaaaaactacacctactaccaccacacagctcactaccaatggcttttttgccatgcttcaagtggctgaaaatagcaccagcattcaacccaccccacccagtgaggaaattcccaaatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctatgccttttagttttttatatcattacctctgctctttgtgaatcagtggataaagatgttactattaccactggttctaattatacactgaaaggaccaccctcaggtatgctttcgtggtattgctattttggaactgacactgatcaaactgaattatgcaattttcaaaaaggcaaaacctcaaactctaaaatctctaattatcaatgcaatggcactgatctgatactactcaatgtcacgaaagcatatggtggcagttattcatgccctggacaaaacactgaagaaatgattttttacaaagtggaagtggttgatcccactactccacctccacccgccacaactactcacaccacacacacagaacaaagcacagcagaggcagcaaagttagccttgcaggtccaagacagttcatttgttggcattacccctacacctgatcagcggtgtccggggctgctcgtcagcggcattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcgctctagttttttgttctttgattggcattgtttttaatagtaaaattaccagagttagctttattaaacatgttaatgtaactgaaggagataacatcacactagcaggtgtagaaggtgctcaaaacaccacctggacaaaataccatctaggatggagagatatttgcacctggaatgtaacttattattgcataggagttaatcttaccattgttaacgctaaccaatctcagaatgggttaattaaaggacagagtgttagtgtgaccagtgatgggtactatacccagcatagttttaactacaacattactgtcataccactgcctacgcctagcccacctagcactaccgcacagacaaccacatacagtacatcaaatcagcctaccaccactacagcagcagaggttgccagctcgtctggggtccgagtggcatttttgatgttggccccatctagcagtcccactgctagtaccaatgagcagactactgaatttttgtccactgtcgagagccacaccacagctacctccagtgccttctctagcaccgccaatctctcctcgctttcctctacaccaatcagtcccgctactactcctagccccgctcctcttcccactcccctgaagcaaacagacggcggcatgcaatggcagatcaccctgctcattgtgatcgggttggtcatcctggccgtgttgctatactacatcttctgccgccgcattcccaacgcgcaccgcaagccggcctacaagcccatcgttatcgggcagccggagccgcttcaggtggaagggggtctaaggaatcttctcttctcttttacagtatggtgattgaattatgattcctagacaattcttgatcactattcttatctgcctcctccaagtctgtgccaccctcgctctggtggccaacgccagtccagactgtattgggcccttcgcctcctacgtgctctttgccttcatcacctgcatctgctgctgtagcatagtctgcctgcttatcaccttcttccagttcattgactggatctttgtgcgcatcgcctacctgcgccaccacccccagtaccgcgaccagcgagtggcgcggctgctcaggctcctctgataagcatgcgggctctgctacttctcgcgcttctgctgttagtgctcccccgtcccgtcgacccccggacccccacccagtcccccgaggaggtccgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcaacctcaggcacacgcactaccaccaccaccacagcctaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatc

SEQ ID NO: 217 - protein, 187 aa, Artificial Sequence; identical to SEQ ID NO: 52
  Synthetic Construct

SEQ ID NO: 218 - protein, 209 aa, Artificial Sequence; identical to SEQ ID NO: 53
  Synthetic Construct

SEQ ID NO: 219 - protein, 135 aa, Artificial Sequence; identical to SEQ ID NO: 54
  Synthetic Construct

SEQ ID NO: 220 - DNA, 38668 bp, Artificial Sequence
  Simian adenovirus A1295 clone
  misc_feature (5)..(12): Swa\I
  repeat_region (16)..(142): ITR
  misc_feature (448)..(473): I-Ceu recognition site
  misc_feature (461)..(462): cleavage point for bottom strand
  misc_feature (465)..(466): cleavage point for top strand
  enhancer (815)..(1075): Enhancer
  misc_feature (1076)..(1303): CMV\promoter
  TATA_signal (1277)..(1280): TATA
  CDS (1399)..(2490): Gag\short
  polyA_signal (2643)..(2845): BGH-PolyA
  misc_feature (2918)..(2956): PI-Scel recognition sequence
  misc_feature (2928)..(2929): cleavage point on bottom strand
  misc_feature (2932)..(2933): cleavage point on top strand
  CDS (2957)..(3346): E1b\55K
  CDS (3433)..(3858): pIX
  misc_feature (3923)..(5544): IVa2    complement (3923..5253,5532..5544)
  misc_feature (8400)..(13769): pTP   complement (8400..10328,13761..13769)
  CDS (10758)..(11936): 52K
  CDS (11963)..(13732): pIIIa
  CDS (13809)..(15410): penton
  CDS (15418)..(15996): pVII
  CDS (16044)..(17069): V
  CDS (17093)..(17323): pX
  CDS (17359)..(18132): pVI
  CDS (18242)..(21061): hexon
  CDS (21082)..(21708): protease
  misc_feature (21790)..(23325): DBP    complement (21790..23325)
  CDS (23351)..(25771): 100K
  CDS (26405)..(27085): pVIII
  CDS (27089)..(27406): E3\12.5K
  CDS (27980)..(28507): E3\gp19K
  CDS (28541)..(29269): E3\CR1-beta
  CDS (29285)..(29905): E3\CR1-gamma
  CDS (30812)..(31084): E3\RID-alpha
  CDS (31087)..(31524): E3\/RID-beta
  CDS (32179)..(33504): fiber
  misc_feature (33598)..(34745): E4\orf6/7    complement (33598..33849,34572..34745)
  misc_feature (33849)..(34745): E4\orf6    complement (33849..34745)
  misc_feature (34651)..(35016): E4\orf4    complement (34651..35015)
  misc_feature (35028)..(35378): E4\orf3    complement (35028..35378)
  misc_feature (35378)..(35764): E4\orf2    complement (35378..35764)
  misc_feature (35817)..(36188): E4\orf1    complement (35817..36188)
  repeat_region (36469)..(36595): ITR   complement (36469..36595)
  misc_feature (36599)..(36606): Swa\I
  rep_origin (36844)..(36844): ORI
  misc_feature (37602)..(38465): AP(R)    complement (37602..38465)
aattatttaaatccccatcatcaaataatatacctcaaactttttgtgcgcgttaatatgcaaatgagccgtttgaatttggggatggaggaaggtgattggccgagaggagggcgaccgttaggggcggggcgagtgacgttttgatgacgtggtcgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacgtaactataacggtcctaaggtagcgaaagctcagatctggatctcccgatcccctatggcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacagagagatgggtgcgagagcgtcagtattaagcgggggagaattagatcgatgggaaaaaattcggttaaggccagggggaaagaagaagtacaagctaaagcacatcgtatgggcaagcagggagctagaacgattcgcagttaatcctggcctgttagaaacatcagaaggctgtagacaaatactgggacagctacaaccatcccttcagacaggatcagaggagcttcgatcactatacaacacagtagcaaccctctattgtgtgcaccagcggatcgagatcaaggacaccaaggaagctttagacaagatagaggaagagcaaaacaagtccaagaagaaggcccagcaggcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaggacctgaacacgatgttgaacaccgtggggggacatcaagcagccatgcaaatgttaaaagagaccatcaatgaggaagctgcagattgggatagagtgcatccagtgcatgcagggcctattgcaccaggccagatgagagaaccaaggggaagtgacatagcaggaactactagtacccttcaggaacaaataggatggatgacaaataatccacctatcccagtaggagagatctacaagaggtggataatcctgggattgaacaagatcgtgaggatgtatagccctaccagcattctggacataagacaaggaccaaaggaaccctttagagactatgtagaccggttctataaaactctaagagctgagcaagcttcacaggaggtaaaaaattggatgacagaaaccttgttggtccaaaatgcgaacccagattgtaagaccatcctgaaggctctcggcccagcggctacactagaagaaatgatgacagcatgtcagggagtaggaggacccggccataaggcaagagttttgtagggatccactagttctagactcgagggggggcccggtacctttaagaccaatgacttacaaggcagctgtagatcttagccactttttaaaagaaaaggggggactggaagggctaattcactcccaaagaagacaagataaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcacatatgctggccaccgtgcatgtggcttcccattcccgcaagccctggcctgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcggggaggacctgcatgagggccagaatgactgaaatctgtgcttttctgtgtgttgcagcagcatgagcggaagcggctcctttgagggaggggtattcagcccttatctgacggggcgtctcccctcatgggcgggagtgcgtcagaatgtgatgggatccacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggattttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttagaagggaaggcgtgaaagaatttggcgacgcccttgtgcccgcccaggttttccatgcactcatccatgatgatggcgatgggcccgtgggcggcggcctgggcaaaaacgtttcgggggtcggacacatcatagttgtggtcctgggtgagatcatcataggccattttaatgaatttggggcggagggtgcctgactgggggacaaaggtaccctcgatcccgggggcgtagttcccctcgcagatctgcatctcccaggctttgagctcggagggggggatcatgtccacctgcggggcgataaagaacacggtttccggggcgggggagatgagctgcgccgaaagcaagttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcatccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcttcgagcggtgtgccacggtcctcctcgtagaggaaccccgcccactccgagacgaaagcccgggtccaggccagcacgaaggaggccacgtgggacgggtagcggtcgttgtccaccagcgggtccactttttccagggtatgcaaacacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagtttggtggcgaaggagccgtagagggcgttggaaaggagcttggcgatagagcgcatggtctggttcttttccttgtctgcgcgctccttggccgcgatgttgagctgcacgtactcgcgcgccacgcacttccattcggggaagacggtggtcagctcgtcgggcacgattctgacctgccagccccggttatgcagggtgataaggtccacactggtggccacctcgccgcgcaggggctcattagtccagcagaggcgcccgcccttgcgcgagcagaaggggggcagggggtcgagcatgacctcgtcgggggggtcggcatcgatggtgaagatgccgggcaggagatcggggtcaaagtagctgatggaagtggccagatcgtccagggcagcttgccattcgcgcacggccagcgcgcgctcgtaggggctgaggggcgtgccccagggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggcgcgaggagccccgggcccaggttggtgcgactgggcttttcggcgcggtagacgatctggcgaaagatggcatgcgagttggaggagatggtgggcctttggaagatgttgaagtgggcgtgggggagaccgaccgagtcgcggatgaagtgggcgtaggagtcttgcagcttggcgacgagctcggcggtgacgaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaggtgtccctgaccatgactttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaacggttggggcacctcggcccggttgttgatgacctgggcggcgagcacgatctcgtcgaaaccgttgatgttgtggcccacgatgtaaagttccacgaatcgcgggcggcccttgacgtggggcagtttcttgagctcctcgtaggtgagctcgtcggggtcgctgaggccgtgctgctcgagcgcccagtcggcgagatgggggttggcgcggaggaaggaagtccagagatccacggccagggcggtctgcaggcggtcccggtactgacgaaactgctgcccgacggccattttttcgggggtgacgcagtagaaggtgcgggggtccccgtgccaacgatcccatttgagctggagggcaagatcgagggcgagctcgacgaggcggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggtgtgaccaccgtcccccgtttcttcttgggcggctggggaggcggtgcctcttccatggttagaagcggcggcgaggacgcgcgccgggcggcaggggcggctctgggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtaaaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggttggagggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcctgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggccggatgaaactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgttttttgtttttgccagatgcatcccgtactgcggcagatgcgcccccaccaccctccaccgcaacaacagccccctcctccacagccggcgcttctgcccccgccccagcagcagcagcaacttccagccacgaccgccgcggccgccgtgagcggggctggacagagttatgaccaccagctggccttggaagagggcgaggggctggcgcgcctgggggcgtcgtcgccggagcggcacccgcgcgtgcagatgaaaagggacgctcgtgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcacagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcaggcggtcccccctacgtagaagaggtggacgaggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctacaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgatgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgctctgcgcctgatggtgaccgaggtgccccagagcgaggtgtaccagtccgggccggactacttcttccagaccagtcgccagggcttgcagaccgtgaacctgagccaggctttcaagaacttgcagggattgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacttgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataagctgatggactacttgcatcgggcggccgccatgaactcggactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgtcgcccgtcctcggcgctgtccggccgggagggtgctgccgcggcggtgcccgaggccgccagtcctttcccgagcttgcccttctcgctgaacagtattcgcagcagcgagctgggcaggatcacgcgtccgcgcttgctgggcgaggaggagtacttgaatgactcgctgttgagacccgagcgggagaaaaacttccccaacaacgggatagagagcctggtggacaagatgagccgctggaagacgtatgcgcaggagcacagggacgatccgtcgcagggggccacgagccggggcagcgcggcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgtttagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaacggggtcacagtaggggatgactatgatggtagtcaggatatcttggagtatgaatgggtggagtttgagctgcccgaaggcaacttctcggtgaccatgaccatcgacctgatgaacaacgccatcatcgacaattacttggcggtggggcggcagaacggggtgctcgagagcgacatcggcgtgaagttcgacaccaggaacttcaggctgggctgggaccccgtgaccgagctggtcatgccaggggtgtacaccaacgaggccttccatcccgatattgtcttgctgcccggctgcggggtggacttcaccgagagccgcctcagcaacctgctgggcattcgcaagaggcagcccttccaggagggtttccagatcatgtacgaggatctggaggggggcaacatccccgcgctcctggatgtcgacgcctatgagaaaagcaaggaggaagcagcagctgaagcaactgcagcggtagccaccgcctctaccgaggtcaggggcgataattttgcaagcgctgcggcagtggcagcggccgaggcggctgaaaccgaaagtaagatagtcattcagccggtggagaaggatagcaaggacaggagctacaacgtgctgccggacaagataaacaccgcctaccgcagctggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctttcgagccgcaccttctaaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccccgcggcggcggtgaaggaggaaagaaagccccgcaaaatcaagcgggtcaaaaaggacaaaaaggaagaagatgatgtggacggattggtggagtttgtgcgcgagttcgcccccaggcggcgcgtgcagtggcgcgggcggaaggtgcaaccggtgctgagacccggcaccaccgtggttttcacgccaggcgagcgctccggcaccgcctccaagcgctcctacgacgaggtgtacggggatgatgatattctggaacaggcggccgagcgcctgggcgagtttgcttacggcaagcgcagccgctccgcgccgaaggaagaggcggtgtccatcccgctggaccacggcaaccccacgccgagcctcaagcccgtgaccctgcagcaggtgctgccgaccgcggcgccgcgaagggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccatcggctcctagccgaagaccccggcgcaagtacggcgcggccagcctgctgatgcccaactacgcgctgcatccttccatcatccccacgcctggctaccgcggcacgcgcttctaccgcggtcatacaaccagccgccgccgcaagaccaccactcgccgccgccgtcgtcgcaccgccgctgcaactacccctgccgccttggtgcggagagtgtaccgccgcggccgcgcgcctctgaccctgccgcgcgcgcgctaccacccgagcatcgccatttaaaactttcgcctgctttgcagatggccctcacatgccgcctccgcgtccccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtgaaactgggtctgcccaccacgcggcccatcgcgcccctggccaccggggtgctgaaacccgaaagtagtaagcccgcgaccctggacttgcctcctcccgcttcccgcccctccacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcactgcctacaacagcctggcccccaagggagcacccaacacttgccagtggaaggactctgacaacaaaatgcatacctttggggtagctgccatgcccggtgttactgggaaaaagatagaagctgatgggctgcctattggaatagattcaacttctggaactgacaccataatttatgctgataaaactttccaacccgagccacaggttggaaatgacagttgggttgacaccaatggtgcagaggaaaaatatggaggcagagctctcaaggacactacaaatatgaaaccctgctatggttctttcgccaagcccaccaacaaagaaggtggtcaggctaacttaaaagattccgaaactgccaccaccactcctaactatgatatagatctggctttctttgacagcaaaaatatcgccgctaactacgatccagatattgtaatgtatacagaaaatgttgacctgcagactccagatactcatattgtatacaaacctggaacagaggacaccagctctgaatccaatttgggtcagcaggccatgcccaacagacccaactatattggtttcagggacaactttatcggtctcatgtactacaacagcactggcaatatgggggtgctggccggtcaggcctctcagctgaatgctgtggttgacttgcaagacagaaacaccgagctgtcctaccagctcttgcttgactctctgggtgacagaaccaggtatttcagtatgtggaatcaggcggtggacagctatgatcctgatgtgcgcattattgaaaaccatggtgtggaagatgaattgccaaactattgctttccattgaatggtgtgggatttacagatacttaccagggtgttaaagttaaaacagatgcaaatgctggaaacaatggaacacagtgggacaaagatgacaccacagttagcactgctaatgaaatccatggaggcaatccttttgccatggaaatcaacattcaggccaacctgtggcggaacttcctctatgccaacgtggccctctatttgcctgataaatacaaatacacacctgccaacatcaccctgcccaccaacaccaacacctacgattacatgaacggccgggtggtggcgccctcgctggtggacgcctacatcaacatcggggcgcgctggtcgctggaccccatggacaacgtgaatcccttcaaccaccaccgcaacgcggggctgcgctaccgctccatgcttctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctatcccatcccggccaacgccaccaacgtgcccatatccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaatgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccatacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaaattgcttcttgcaagctatggcctgtgccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaacaatcaagacatgtaaaccgtgtgtgtatgttaaaatgtctttaataaacagcactttcatgttacacatgcatctgagatggtttattatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccaggaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgcctgcccatggtgggcacgcagccgggcttgtggttgcaatcgcagtgcagggggatcagcatcatctgggcctggtcggcgttcatccccgggtacatggccttcatgaaagcctccaattgcctaaaagcctgctgggccttggctccctcggtgaagaagaccccgcaagacttgctagagaactggttggtagcgcacccggcgtcatgcacgcagcagcgcgcgtcgttgttggccagctgcaccacgctgcgcccccagcggttctgggtgatcttggcccggttggggttctccttcagcgcgcgctgcccgttctcgctcgccacatccatctcgatcatgtgctccttctggatcatggtggtcccgtgcaggcaccgcagcttgccctcggtctcggtgcaaccgtgcagccacagcgcgcacccggtgcactcccagttcttgtgggcgatctgtgaatgcgcgtgcacgaacccttgcaggaagcggcccatcatggtcgtcagggtcttgttgctagtgaaggtcagcggaatgccgcggtgctcctcgttgatgtacaggtggcagatgcggcggtacacctcgccctgctcgggcatcagctggaagttggctttcaggtcagtctccacgcggtagcggtccatcagtatagtcatgatttccatgcccttctcccaggccgagacgatgggcaggctcatagggttcttcaccatcatcttagcgctagccgccgcagccagggggtcgctctcgtccagggtctcaaagctccgcttgccgtccttctcggtgatccgcacgggggggtagctgaagcccacggccgccagctcctcctcggcctgcctttcgtcctcgctgtcctggctgacgtcctgcagaaccacatgcttggtcttgcggggtttcttcttgggtggcagtggcggcggagatgcttgcggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgatcgggggtgcgctcccggcggcgctctgactgacttcctccgcggccggccattgtgttctcctagggaacaacaagcatggagactcagccatcgccaacctcgccatctgcccccaccaccgccgacgagaagcagcagcagcagaatgaaagcttaaccgccccgccgcccagccccgccacctccgacgcggcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagaaaacgagcagagtcaggctgggctcgagcatggcgactacctccacctgagcgggggggaggacgcgctcatcaagcatctggcccggcaggccatcatcgtcaaggatgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttgaacctgggccccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagatgcaggaccccgagagctccgaggagggcaagcccgtggtcagcgacgagcagctggcccggtggctgggtcctaatgctacccctcagagtttggaagagcggcgcaagctcatgatggccgtggtcctggtgaccgtggagctggagtgtctgcgccgcttcttcgccgacgcggagaccctgcgcaaggtcgaggagaacctgcactacatcttcaggcacgggttcgtgcgccaggcctgcaagatttccaacgtggagctgaccaacctggtctcctacatgggcatcttgcacgagaaccgactggggcagaacgtgctgcacaccaccctgcgcggggaggcccggcgcgactacatccgcgactgcgtctacctctacctctgccacacctggcagacgggcatgggcgtgtggcagcagtgcctggaggagcagaacctgaaagagctctgcaagctcctgcagaagaacctcaagggtctgtggaccgggttcgacgagcgcaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggcgagggatcggccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcggccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtaaacttcccccgcaacatcttgcattactaccgtcacctccacagcccctactacttccaagaagaggcagcagcagaaaaagaccagcagaaaaccagcagcagctagaaaatccacagcggcggcagcgacaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccctcatcatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtgctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagccagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaatcggtcactgaccttcaccgggaacgagaccgagctccagctccagtgtaagccccacaagaagtacctcacctggctgtaccagggctccccgatcgccgttgttaaccactgcgacgacgacggagtcctgctgaacggtcccgccaaccttactttttccacccgcagaagcaagctcgagctcttccaacccttcctccccgggacctatcagtgcatctcgggaccctgccatcacaccttccacctgatcccgaataccacctcttccccagcgccgctccccactaacaaccaaactaaccaccaccaacgctaccgacgcgacctcgttgaatctaataccacccacaccggaggtgagctccgaggtcctgaatcctctgggatttattacggcccctgggaggtggtggggttaatagctttaggcttagtagcgggtgggcttttggctctctgctacctatacctcccttgcttttcctacttagtggtgctttgttgctggtttaagaaatggggaagatcaccctagtgtgcggtgtgctggtgacggtggtgctttcgattctgggagggggaagcgcggctgtagtgacggagaagaaggccgatccctgcttgactttcaaccccgataaatgccggctgagttttcagcccgatggcaatcggtgcgcggtgttgatcaagtgcggatgggaatgcgagagtgtggcgattcagtataaaaacaagacgcggaacaatactctcgcgtccacatggcagcccggggaccccgagtggtacaccgtctctgtccctggtgctgacggctccctccgcacggtgaacaacactttcatttttgagcacatgtgcgaaaccgccatgttcatgagcaagcagtacggtatgtggcctccacgaaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacacacttttttcacacacctttttcagaccatggcctctgttaaagttttgatcatagtcagtttaattgcttatgcctctggctatgcaaacattaaaaaaaccctctatgttggttctgactctatattagagggtacccaatccggagctaaggtttcatggtatttttatagaaccacaactgatccagttaaactctgtaagggtgaattaccacgcacgcataaaactccacttacattcagctgcagcaataataatcttacacttttttcggtcactaaacaatatgctggcacttactacagcacaaattttcatactgggcaagataaatactatactattacagtggccgatccaaccactcctagaactactactaaacccaccacaactaaaaagcccactacacctaaaaagcctaccacacccaaaaccactaagacaacaactaagaccactaccacagagccaaccacaaccagcaccacacttgctataactacacacacggagctgacctcacaagcaactactgaaaatggttttgccctattgcaaaagggggataacagtagcagcagtcctctgcctactacccccagtgaggaaatacctaagtccatggttggcattatcgctgccgtagtggtgtgtatgctgattatcatcttgtgcatgatgtactatgcctgctactacagaaaacacaggctgaacaataagctggaccccctactgaatgttgatttttaattttttagaaccatgaagatcctaagcctttttgttttttctataattattacctctgctctatgcaattccaacgatgacgttactgtcgttgttggatccaattacacactgaaaggacctccaaaaggtatgctttcgtggtattgctggtttggaaacgatgagcaacaaacagagctctgcaatcttaaaaatggaaaagtctcaaacccaaaaatctccaattatatatgcaatggcactgatttaatactgctcaatatcacgaaagcatatgctggcagttatacttgtcctggagacaatgatgacatgatttttaaaaaattgattgtggttgatcccactaccccagcaccacccaccacaactaccaaggcacataccacagacacacaggaaaccactccagaggcagaagtagcagagttagcaaagcagattcatgaagattcctttgttgccaatacccccacacaccccggaccgcaatgtccagggccattagtcagcggcattgtcggtgtgctttgcgggttagcagttataatcatctgcatgttcatttttgcttgctgctacagaaggctccaccgacaaaaatcagacccactgctgaacctctatgtttaatttttgattttccagagccatgaaggcacttagcactttagtatttttgtccttgattggcattgtattcagtgctgggtttttgaaaaatcttaccattattgaaggcgaaaatgcaacactggtaggcatcagtggtcagaatgttagctggttaaaataccatctagatgggtggaaacctatttgcacctggaatgtcagtgtgtacacatgccatggtgttaacctcaccattaccaatgccacccaagatcagaatggcaggtttaagggtcagagttttactagcaacaatgggtatgaaacccataacatgttcatctatgatgtcactgtcatatcaaataagactacacctaccacccagacacccactacacacagctcaacacatgccatgcagaccactcagacaaccacatacactacatccactgaacccaccaccactacagcagaggtaaccagcacagcgcctcagccccaggcattggctttaagggctgcacagtctagcagcatgactgctaaaaccaatgagcagactactgaatttttgtccactactcagagtcgcaccacagctacctcgagtgccttctctagcaccgccaatctcacctcgctttcctctatgccaatcagtaatgctactaccctccccgctcctcttcccactcctctgaagcaatccgagtctagcacgcagctgcagatcaccctgctcattgtgatcggggtggtcatcctggcagtgctgctctactttatcttctgccgccgcatccccaacgcgaaaccggcctacaagcccattgttatcgggacgccggagccgcttcaggtggagggaggtctaaggaatcttctcttctcttttacagtatggtgatttgaactatgattcctagacatttcattatcacttctctaatctgtgtgctccaagtctgtgccaccctcgctctcgtggctaacgcgagtccagactgcattggagcgttcgcctcctacgtgctctttgccttcatcacctgcatctgctgctgtagcatagtctgcctgcttatcaccttcttccagttcattgactgggtctttgtgcgcatcgcctacctgcgccaccatccccagtaccgcgaccagagagtggctcaactgttgaggctcatctgatgataagcatgcgggctctgctactactcgcgcttgcactagctcccctcgccgcccccttctccctcaaatcccccacccaatcccctgaagaggttcgaaaatgtaaattccaagaaccctggaaattcctcaaatgctaccagctcaaatcagaaatgcaccccagctggatcatgatcattggaatcgtgaacatccttgcctgtaccctcatctcctttgtgatttacccctgctttaactttgggtggaacgcacccgaggcgctctggctcccgcctgatcccgacacaccaccacagcagcagcaaaatcaggcacatgcaccaccacagcctaggccacaatacatgcccatcttagactatgaggccgagccacagcgagccatgcttcctgctattagttacttcaatctaaccggcggagatgactgaccccatggccaacaacaccgtcaacgacctcctggacatggacggccgcgcctcggagcagcgactcgcccaactccgcatccgccagcagcaggagagagccgtcaaggagctgcaggatgcggtggccatccaccagtgcaagagaggcatcttctgcctggtgaaacaggccaagatctccttcgaggtcacttccaccgaccatcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccctgatcaagaccctctgcggcctccgcgacctcctccccatgaactaatcaactaacccactacccctttaccctccagtaaaaataaagattaaagagttgatgattgaattgatcaataaagaatcacttacttgaaatctgaaaccaggtctctgtccatgttttctgccagcagcacttcactcccctcttcccagctctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaacggggctgtcaccctcaagctgggggatggggtggacctcgacgactcgggaaaactcatctccaaaaatgccaccaaggccactgcacctctcagtatttccaacggcaccatttcccttaacatggatacccctttttacaccagcgatggaaaattatccttacaagtttatccaccattaaacatattaagaacacccattatcaacacattagctttagcatataagtcaggtttaggtgtaagtgacaaatcccttgctgttcaattagcttctccactcacttttgatgaaaaaggaaatatagaaattaacttgggaagtgggccattaacagttgcatcaaatcaacttagcattaactgtcaaagaggtgtacatatcactactgcaggagatgcgcttgaaacaaacataagttgggctaaaggcataagatttgaaagtgatgccatagctgcaaacattggcaaaggattagaattcggaaccactagtacagagtccgatgtcacagatgcatttccaattcaagttaaattgggcactggccttacatttgacagcacaggagctattgttgcttggaacaaagaggatgacaagcttacactatggaccacagctgacccatctccaaactgtcacatatattctgcaaaagatgctaagcttactctctgtttaacaaagtgtggcagtcagatactgggcactgtttccctcatagctgttaatactggcagcttaaatccaataacgggaacagtacatactgctcttgtttcacttaaatttgatgcaagtggagttttgcaagccagttcaacattggacaaagaatattggaatttcagaaaagatgatgtaacacctgcagatccctacactaatgctataggttttatgcccaaccttaatgcatatccaaaaaacacaagtgcagctgcaaagagtcacattgtggggaaagtatacctcaatggtgatgtagccaaaccactggacttgataattacatttaatgaaaccagcgatgaaacctgtacctattgcattaactttcagtggcagtggggagctgatgaatataaaaatgaaacgcttgctgtcagttcattcaccttctcctacattgctaaagaataaaccctgcatgccaacccctttcccaactactatggaaaactctgaagcagaaaaaataaaagttcaagtgttttattgattcaacagttttcacagaattcgagtagttattttccctccaccctcccaactcatggaatacaccaccctctccccacgcacagccttaaacatctgaatgccattggtaatggacatggttttggtctccacattccacacagtttcagagcgagccagtctcgggtcggtcagggagatgaaaccctccgggcactcctgcatctgcacctcaaagttcagtagctgagggctgtcctcggtggtcgggatcacagttatctggaagaagagcgatgagagtcataatccgcgaacgggatcgggcggttgtggcgcatcagaccccgcagcagtcgctgtctgcgccgctccgtcaagctgctgctcaaagggtccgggtccagggactccctgcgcatgatgccgatggccctgagcatcagtcgcctggtgcggcgggcgcagcagcggatgcggatctcactcaggtcggagcagtacgtgcagcacagcaccaccaagttgttcaacagtccatagttcaacgtgctccagccaaaactcatctgtggaactatgctgcccacatgtccatcgtaccagatcctgatgtaaatcaggtggcgccccctccagaacacactgcccatgtacatgatctccttgggcatatgcaggttcaccacctcccggtaccacatcacccgctggttgaacatgcagccctggataattctgcggaaccagatggccagcaccgccccgcccgccatgcagcgcagggaccccgggtcctgacagtggcagtggaggacccaccgctcgcggccgtggatcaactgggagctgaacaggtctatgttggcacagcacaggcacacgctcatgcatgtcttcagcactctcagttcctcgggggtcaggaccatgtcccagggcacggggaactcttgcaggacagtgaacccggcagaacagggcagccctcgcacacaacttacattgtgcatggacagggtatcgcaatcaggcagcaccggatgatcctccaccagagaagcgcgggtctcggtctcctcacaacgaggtaagggggccggcggttggtacggatgatggcgggatgacgctaatcgtgttctggatcgtgtcatgatggagcttcttcctgacatcttcgtatttcatgtagcagaacctggtccgggcactgcacaccgctcgccggcgacggtctcggcgcttcgagcgctcggtgttgaagttgtaaaacagccactccctcagagcgtgcagtatctcttgagcctcttgggtgatgaaaatcccatccgccctgatggctctgatcacatcgaccacggtggaatgggccagacccagccagatgatgcaattttgttgggtttcggtgacggcgggggagggaagaacaggaagaaccatgattaactttattccaaacggtctcggagcacttcaaaatgcaggtcgcggagatggcacctctcgcccccactgtgttgatggaaaataacagccaggtcaaaggtgacacggttctcgagatgttccacggtggcttccagcaaagcctccacgcgcacatccagaaacaagaggacagcgaaagcgggagcgttctctaattcctcaatcatcatattacactcctgcaccatccccagataattttcatttttccagccttgaatgatttgaactagttcctgaggtaaatccaagccagccatgataaaaagctcgcgcagagcgccctccaccggcattcttaagcacaccctcataattccaagagattctgctcctggttcacctgcagcagattaacaaggggaatatcaaaatctctgccgcgatctctaagctcctccctcagcaataactgcaagtactctttcatatcttctccgaaatttttagccatagggccgccaggaatgagagcagggcaagccacattacagataaagcgaagtcctccccagtgagcattgccaaatgtaagattgaaataagcatgctggctagacccggtgatatcttccagataactggacagaaaatcaggcaagcaatttttaagaaaatcaacaaaagaaaagtcgtccaggtgcaagtttagagcctcaggaacaacgatggaataagtgcaaggagtgcgttccagcatggttagtgtttttttggtgatctgtagaacaaaaaataaacatgcaatattaaaccatgctagcctggcgaacaggtgggtaaatcactctttccagcaccaggcaggctacggggtctccggcgcgaccctcgtagaagctgtcgccatgattgaaaagcatcaccgaaagactttcccggtggccggcatggatgattcgcgaagacgcgtacactccgggaacattggcatccgtgagtgaaaaaaatcgccccaagaagccccgaggcactacaatgctcaaccttaattccagcagagcgaccccatgcggatgaagcacaaaattggtaggtgcgtaaaaaatgtaattactcccctcctgcacaggcagcaaagcccccgctccctccagaaacacatacaaagcctcagcgtccatagcttaccgagcacggcaggcgcaagattcagagaaaaggctgagctctaacctgactgcccgctcctgagctcaatatatagccctaacctacactgacgtaaaggccaaagtctaaaaatacccgccaaaatgacacacacgcccagcacacgcccagaaaccggtgacacactcaaaaaaatacgtgcgcttcctcaaacgcccaaaccggcgtcatttccgggttcccacgctacgtcaccgctcagcgactttcaaattccgtcgaccgttaaacacgtcactcgccccgcccctaacggtcgccctcctctcggccaatcaccttcctccatccccaaattcaaacggctcatttgcatattaacgcgcacaaaaagtttgaggtatattatttgatgatgatcatttaaatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaag

SEQ ID NO: 221 - protein, 363 aa, Artificial Sequence; identical to SEQ ID NO: 169
  Synthetic Construct

SEQ ID NO: 222 - protein, 130 aa, Artificial Sequence
  Synthetic Construct
HMLATVHVASHSRKPWPEFEHNVMTRCNMHLGSRRGMFMPYQCNLNYVKVLLEPDAMSRVSLTGVFDMNVEVWKILRYDESKTRCRACECGGKHARFQPVCVEVTEDLRPDHLVLSCTGTEFGSSGEESD

SEQ ID NO: 223 - protein, 142 aa, Artificial Sequence; identical to SEQ ID NO: 3
  Synthetic Construct

SEQ ID NO: 224 - protein, 393 aa, Artificial Sequence; identical to SEQ ID NO: 60
  Synthetic Construct

SEQ ID NO: 225 - protein, 590 aa, Artificial Sequence; identical to SEQ ID NO: 61
  Synthetic Construct

SEQ ID NO: 226 - protein, 534 aa, Artificial Sequence; identical to SEQ ID NO: 62
  Synthetic Construct

SEQ ID NO: 227 - protein, 193 aa, Artificial Sequence; identical to SEQ ID NO: 6
  Synthetic Construct

SEQ ID NO: 228 - protein, 342 aa, Artificial Sequence; identical to SEQ ID NO: 64
  Synthetic Construct

SEQ ID NO: 229 - protein, 77 aa, Artificial Sequence; identical to SEQ ID NO: 65
  Synthetic Construct

SEQ ID NO: 230 - protein, 258 aa, Artificial Sequence; identical to SEQ ID NO: 66
  Synthetic Construct

SEQ ID NO: 231 - protein, 940 aa, Artificial Sequence; identical to SEQ ID NO: 67
  Synthetic Construct

SEQ ID NO: 232 - protein, 209 aa, Artificial Sequence; identical to SEQ ID NO: 68
  Synthetic Construct

SEQ ID NO: 233 - protein, 807 aa, Artificial Sequence; identical to SEQ ID NO: 69
  Synthetic Construct

SEQ ID NO: 234 - protein, 227 aa, Artificial Sequence; identical to SEQ ID NO: 70
  Synthetic Construct

SEQ ID NO: 235 - protein, 106 aa, Artificial Sequence; identical to SEQ ID NO: 71
  Synthetic Construct

SEQ ID NO: 236 - protein, 176 aa, Artificial Sequence; identical to SEQ ID NO: 72
  Synthetic Construct

SEQ ID NO: 237 - protein, 243 aa, Artificial Sequence; identical to SEQ ID NO: 73
  Synthetic Construct

SEQ ID NO: 238 - protein, 207 aa, Artificial Sequence; identical to SEQ ID NO: 74
  Synthetic Construct

SEQ ID NO: 239 - protein, 91 aa, Artificial Sequence; identical to SEQ ID NO: 76
  Synthetic Construct

SEQ ID NO: 240 - protein, 146 aa, Artificial Sequence; identical to SEQ ID NO: 77
  Synthetic Construct

SEQ ID NO: 241 - protein, 442 aa, Artificial Sequence; identical to SEQ ID NO: 78
  Synthetic Construct

SEQ ID NO: 242 - DNA, 31980 bp, Artificial Sequence
  Simian adenovirus A1295 clone
  CDS (25485)..(26048): 22K
  CDS (27363)..(27995): E3\CR1-alpha
  CDS (31520)..(31921): E3\14.7K
aattatttaaatccccatcatcaaataatatacctcaaactttttgtgcgcgttaatatgcaaatgagccgtttgaatttggggatggaggaaggtgattggccgagaggagggcgaccgttaggggcggggcgagtgacgttttgatgacgtggtcgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtgtttttcacctaaatttccgcgtacgtaactataacggtcctaaggtagcgaaagctcagatctggatctcccgatcccctatggcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacagagagatgggtgcgagagcgtcagtattaagcgggggagaattagatcgatgggaaaaaattcggttaaggccagggggaaagaagaagtacaagctaaagcacatcgtatgggcaagcagggagctagaacgattcgcagttaatcctggcctgttagaaacatcagaaggctgtagacaaatactgggacagctacaaccatcccttcagacaggatcagaggagcttcgatcactatacaacacagtagcaaccctctattgtgtgcaccagcggatcgagatcaaggacaccaaggaagctttagacaagatagaggaagagcaaaacaagtccaagaagaaggcccagcaggcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaggacctgaacacgatgttgaacaccgtggggggacatcaagcagccatgcaaatgttaaaagagaccatcaatgaggaagctgcagattgggatagagtgcatccagtgcatgcagggcctattgcaccaggccagatgagagaaccaaggggaagtgacatagcaggaactactagtacccttcaggaacaaataggatggatgacaaataatccacctatcccagtaggagagatctacaagaggtggataatcctgggattgaacaagatcgtgaggatgtatagccctaccagcattctggacataagacaaggaccaaaggaaccctttagagactatgtagaccggttctataaaactctaagagctgagcaagcttcacaggaggtaaaaaattggatgacagaaaccttgttggtccaaaatgcgaacccagattgtaagaccatcctgaaggctctcggcccagcggctacactagaagaaatgatgacagcatgtcagggagtaggaggacccggccataaggcaagagttttgtagggatccactagttctagactcgagggggggcccggtacctttaagaccaatgacttacaaggcagctgtagatcttagccactttttaaaagaaaaggggggactggaagggctaattcactcccaaagaagacaagataaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcacatatgctggccaccgtgcatgtggcttcccattcccgcaagccctggcctgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaggtgtggaagattctgagatatgatgaatccaagaccaggtgccgagcctgcgagtgcggagggaagcatgccaggttccagcccgtgtgtgtggaggtgacggaggacctgcgacccgatcatttggtgttgtcctgcaccgggacggagttcggttccagcggggaagaatctgactagagtgagtagtgttctggggcggggaggacctgcatgagggccagaatgactgaaatctgtgcttttctgtgtgttgcagcagcatgagcggaagcggctcctttgagggaggggtattcagcccttatctgacggggcgtctcccctcatgggcgggagtgcgtcagaatgtgatgggatccacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctactacggcactctggtggccaactcgagttccaccaataatcccgccagcctgaacgaggagaagctgctgctgctgatggcccagctcgaggccttgacccagcgcctgggcgagctgacccagcaggtggctcagctgcaggagcagacgcgggccgcggttgccacggtgaaatccaaataaaaaatgaatcaataaataaacggagacggttgttgattttaacacagagtctgaatctttatttgatttttcgcgcgcggtaggccctggaccaccggtctcgatcattgagcacccggtggattttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgttgcacaatatctttgaggaggagactgatggccacgggcagccctttggtgtaggtgtttacaaatctgttgagctgggagggatgcatgcggggggagatgaggtgcatcttggcctggatcttgagattggcgatgttaccgcccagatcccgcctggggttcatgttgtgcaggaccaccagcacggtgtatccggtgcacttggggaatttatcatgcaacttagaagggaaggcgtgaaagaatttggcgacgcccttgtgcccgcccaggttttccatgcactcatccatgatgatggcgatgggcccgtgggcggcggcctgggcaaaaacgtttcgggggtcggacacatcatagttgtggtcctgggtgagatcatcataggccattttaatgaatttggggcggagggtgcctgactgggggacaaaggtaccctcgatcccgggggcgtagttcccctcgcagatctgcatctcccaggctttgagctcggagggggggatcatgtccacctgcggggcgataaagaacacggtttccggggcgggggagatgagctgcgccgaaagcaagttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggccgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcatccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcttcgagcggtgtgccacggtcctcctcgtagaggaaccccgcccactccgagacgaaagcccgggtccaggccagcacgaaggaggccacgtgggacgggtagcggtcgttgtccaccagcgggtccactttttccagggtatgcaaacacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagtttggtggcgaaggagccgtagagggcgttggaaaggagcttggcgatagagcgcatggtctggttcttttccttgtctgcgcgctccttggccgcgatgttgagctgcacgtactcgcgcgccacgcacttccattcggggaagacggtggtcagctcgtcgggcacgattctgacctgccagccccggttatgcagggtgataaggtccacactggtggccacctcgccgcgcaggggctcattagtccagcagaggcgcccgcccttgcgcgagcagaaggggggcagggggtcgagcatgacctcgtcgggggggtcggcatcgatggtgaagatgccgggcaggagatcggggtcaaagtagctgatggaagtggccagatcgtccagggcagcttgccattcgcgcacggccagcgcgcgctcgtaggggctgaggggcgtgccccagggcatgggatgggtgagcgcggaggcgtacatgccgcagatgtcgtagacgtagaggggctcctcgaggatgccgatgtaggtggggtagcagcgccccccgcggatgctggcgcgcacgtagtcatacagctcgtgcgagggcgcgaggagccccgggcccaggttggtgcgactgggcttttcggcgcggtagacgatctggcgaaagatggcatgcgagttggaggagatggtgggcctttggaagatgttgaagtgggcgtgggggagaccgaccgagtcgcggatgaagtgggcgtaggagtcttgcagcttggcgacgagctcggcggtgacgaggacgtccagagcgcagtagtcgagggtctcctggatgatgtcatacttgagctgtcccttttgtttccacagctcgcggttgagaaggaactcttcgcggtccttccagtactcttcgagggggaacccgtcctgatctgcacggtaagagcctagcatgtagaactggttgacggccttgtaggcgcagcagcccttctccacggggagggcgtaggcctgggcggccttgcgcagggaggtgtgcgtgagggcgaaggtgtccctgaccatgactttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaacggttggggcacctcggcccggttgttgatgacctgggcggcgagcacgatctcgtcgaaaccgttgatgttgtggcccacgatgtaaagttccacgaatcgcgggcggcccttgacgtggggcagtttcttgagctcctcgtaggtgagctcgtcggggtcgctgaggccgtgctgctcgagcgcccagtcggcgagatgggggttggcgcggaggaaggaagtccagagatccacggccagggcggtctgcaggcggtcccggtactgacgaaactgctgcccgacggccattttttcgggggtgacgcagtagaaggtgcgggggtccccgtgccaacgatcccatttgagctggagggcaagatcgagggcgagctcgacgaggcggtcgtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccgcgcgggaggcaggtccagacctcggcgcgagcgggtcggagagcgaggacgagggcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccgtgcccctggggtgtgaccaccgtcccccgtttcttcttgggcggctggggaggcggtgcctcttccatggttagaagcggcggcgaggacgcgcgccgggcggcaggggcggctctgggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtaaaggtagttgagcgtggtggcgatgtgctcggtgacgaagaaatacatgatccagcggcggagcggcatctcgctgacgtcgcccagcgcctccaaacgttccatggcctcgtaaaagtccacggcgaagttgaaaaactgggagttgcgcgccgagacggtcaactcctcctccagaagacggatgagctcggcgatggtggcgcgcacctcgcgctcgaaggcccccgggagttcctccacttcctcttcttcctcctccactaacatctcttctacttcctcctcaggcggtggtggcgggggagggggcctgcgtcgccggcggcgcacgggcagacggtcgatgaaacgctcgatggtctcgccgcgccggcgtcgcatggtctcggtgacggcgcgcccgtcctcgcggggccgcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggttggagggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcctgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggccggatgaaactagtaagcgcggaaagcggccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgttttttgtttttgccagatgcatcccgtactgcggcagatgcgcccccaccaccctccaccgcaacaacagccccctcctccacagccggcgcttctgcccccgccccagcagcagcagcaacttccagccacgaccgccgcggccgccgtgagcggggctggacagagttatgaccaccagctggccttggaagagggcgaggggctggcgcgcctgggggcgtcgtcgccggagcggcacccgcgcgtgcagatgaaaagggacgctcgtgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcacagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggcaggcggtcccccctacgtagaagaggtggacgaggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctacaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgatgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgctctgcgcctgatggtgaccgaggtgccccagagcgaggtgtaccagtccgggccggactacttcttccagaccagtcgccagggcttgcagaccgtgaacctgagccaggctttcaagaacttgcagggattgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacttgtaccgcgaggccatcggccaggcgcacgtggacgagcagacctaccaggagatcacccacgtgagccgcgccctgggccaggacgacccgggcaatctggaagccaccctgaactttttgctgaccaaccggtcgcagaagatcccgccccagtacgcgctcagcgccgaggaggagcgcattctgcgatacgtgcagcagagcgtgggcctgttcctgatgcaggagggggccacccccagcgccgcgctcgacatgaccgcgcgcaacatggagcccagcatgtacgccagcaaccgcccgttcatcaataagctgatggactacttgcatcgggcggccgccatgaactcggactatttcaccaacgccatcctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgtcgcccgtcctcggcgctgtccggccgggagggtgctgccgcggcggtgcccgaggccgccagtcctttcccgagcttgcccttctcgctgaacagtattcgcagcagcgagctgggcaggatcacgcgtccgcgcttgctgggcgaggaggagtacttgaatgactcgctgttgagacccgagcgggagaaaaacttccccaacaacgggatagagagcctggtggacaagatgagccgctggaagacgtatgcgcaggagcacagggacgatccgtcgcagggggccacgagccggggcagcgcggcccgtaaacgccggtggcacgacaggcagcggggactgatgtgggacgatgaggattccgccgacgacagcagcgtgttggacttgggtgggagtggtggtaacccgttcgctcacctgcgcccccgcatcgggcgcatgatgtaagaaaccgaaaataaatgatactcaccaaggccatggcgaccagcgtgcgttcgtttcttctctgttgtttagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagacccccaacggggtcacagtaggggatgactatgatggtagtcaggatatcttggagtatgaatgggtggagtttgagctgcccgaaggcaacttctcggtgaccatgaccatcgacctgatgaacaacgccatcatcgacaattacttggcggtggggcggcagaacggggtgctcgagagcgacatcggcgtgaagttcgacaccaggaacttcaggctgggctgggaccccgtgaccgagctggtcatgccaggggtgtacaccaacgaggccttccatcccgatattgtcttgctgcccggctgcggggtggacttcaccgagagccgcctcagcaacctgctgggcattcgcaagaggcagcccttccaggagggtttccagatcatgtacgaggatctggaggggggcaacatccccgcgctcctggatgtcgacgcctatgagaaaagcaaggaggaagcagcagctgaagcaactgcagcggtagccaccgcctctaccgaggtcaggggcgataattttgcaagcgctgcggcagtggcagcggccgaggcggctgaaaccgaaagtaagatagtcattcagccggtggagaaggatagcaaggacaggagctacaacgtgctgccggacaagataaacaccgcctaccgcagctggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctttcgagccgcaccttctaaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggaggatgtccaagcgcaaattcaaggaagagatgctccaggtcatcgcgcctgagatctacggccccgcggcggcggtgaaggaggaaagaaagccccgcaaaatcaagcgggtcaaaaaggacaaaaaggaagaagatgatgtggacggattggtggagtttgtgcgcgagttcgcccccaggcggcgcgtgcagtggcgcgggcggaaggtgcaaccggtgctgagacccggcaccaccgtggttttcacgccaggcgagcgctccggcaccgcctccaagcgctcctacgacgaggtgtacggggatgatgatattctggaacaggcggccgagcgcctgggcgagtttgcttacggcaagcgcagccgctccgcgccgaaggaagaggcggtgtccatcccgctggaccacggcaaccccacgccgagcctcaagcccgtgaccctgcagcaggtgctgccgaccgcggcgccgcgaagggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccatcggctcctagccgaagaccccggcgcaagtacggcgcggccagcctgctgatgcccaactacgcgctgcatccttccatcatccccacgcctggctaccgcggcacgcgcttctaccgcggtcatacaaccagccgccgccgcaagaccaccactcgccgccgccgtcgtcgcaccgccgctgcaactacccctgccgccttggtgcggagagtgtaccgccgcggccgcgcgcctctgaccctgccgcgcgcgcgctaccacccgagcatcgccatttaaaactttcgcctgctttgcagatggccctcacatgccgcctccgcgtccccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtgaaactgggtctgcccaccacgcggcccatcgcgcccctggccaccggggtgctgaaacccgaaagtagtaagcccgcgaccctggacttgcctcctcccgcttcccgcccctccacagtggctaagcccctgccgccggtggccgtggcccgcgcgcgacccgggggcaccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcactgcctacaacagcctggcccccaagggagcacccaacacttgccagtggaaggactctgacaacaaaatgcatacctttggggtagctgccatgcccggtgttactgggaaaaagatagaagctgatgggctgcctattggaatagattcaacttctggaactgacaccataatttatgctgataaaactttccaacccgagccacaggttggaaatgacagttgggttgacaccaatggtgcagaggaaaaatatggaggcagagctctcaaggacactacaaatatgaaaccctgctatggttctttcgccaagcccaccaacaaagaaggtggtcaggctaacttaaaagattccgaaactgccaccaccactcctaactatgatatagatctggctttctttgacagcaaaaatatcgccgctaactacgatccagatattgtaatgtatacagaaaatgttgacctgcagactccagatactcatattgtatacaaacctggaacagaggacaccagctctgaatccaatttgggtcagcaggccatgcccaacagacccaactatattggtttcagggacaactttatcggtctcatgtactacaacagcactggcaatatgggggtgctggccggtcaggcctctcagctgaatgctgtggttgacttgcaagacagaaacaccgagctgtcctaccagctcttgcttgactctctgggtgacagaaccaggtatttcagtatgtggaatcaggcggtggacagctatgatcctgatgtgcgcattattgaaaaccatggtgtggaagatgaattgccaaactattgctttccattgaatggtgtgggatttacagatacttaccagggtgttaaagttaaaacagatgcaaatgctggaaacaatggaacacagtgggacaaagatgacaccacagttagcactgctaatgaaatccatggaggcaatccttttgccatggaaatcaacattcaggccaacctgtggcggaacttcctctatgccaacgtggccctctatttgcctgataaatacaaatacacacctgccaacatcaccctgcccaccaacaccaacacctacgattacatgaacggccgggtggtggcgccctcgctggtggacgcctacatcaacatcggggcgcgctggtcgctggaccccatggacaacgtgaatcccttcaaccaccaccgcaacgcggggctgcgctaccgctccatgcttctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctatcccatcccggccaacgccaccaacgtgcccatatccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaatgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccatacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaaattgcttcttgcaagctatggcctgtgccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaactcccactccgcctactttcgctcccaccgcgcgcgcatcgagaaggccaccgccttcgaccgcatgaacaatcaagacatgtaaaccgtgtgtgtatgttaaaatgtctttaataaacagcactttcatgttacacatgcatctgagatggtttattatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccaggaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcgttggccatcccgaagggggtcatcttgcaggtctgcctgcccatggtgggcacgcagccgggcttgtggttgcaatcgcagtgcagggggatcagcatcatctgggcctggtcggcgttcatccccgggtacatggccttcatgaaagcctccaattgcctaaaagcctgctgggccttggctccctcggtgaagaagaccccgcaagacttgctagagaactggttggtagcgcacccggcgtcatgcacgcagcagcgcgcgtcgttgttggccagctgcaccacgctgcgcccccagcggttctgggtgatcttggcccggttggggttctccttcagcgcgcgctgcccgttctcgctcgccacatccatctcgatcatgtgctccttctggatcatggtggtcccgtgcaggcaccgcagcttgccctcggtctcggtgcaaccgtgcagccacagcgcgcacccggtgcactcccagttcttgtgggcgatctgtgaatgcgcgtgcacgaacccttgcaggaagcggcccatcatggtcgtcagggtcttgttgctagtgaaggtcagcggaatgccgcggtgctcctcgttgatgtacaggtggcagatgcggcggtacacctcgccctgctcgggcatcagctggaagttggctttcaggtcagtctccacgcggtagcggtccatcagtatagtcatgatttccatgcccttctcccaggccgagacgatgggcaggctcatagggttcttcaccatcatcttagcgctagccgccgcagccagggggtcgctctcgtccagggtctcaaagctccgcttgccgtccttctcggtgatccgcacgggggggtagctgaagcccacggccgccagctcctcctcggcctgcctttcgtcctcgctgtcctggctgacgtcctgcagaaccacatgcttggtcttgcggggtttcttcttgggtggcagtggcggcggagatgcttgcggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgatcgggggtgcgctcccggcggcgctctgactgacttcctccgcggccggccattgtgttctcctagggaacaacaagcatggagactcagccatcgccaacctcgccatctgcccccaccaccgccgacgagaagcagcagcagcagaatgaaagcttaaccgccccgccgcccagccccgccacctccgacgcggcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagaaaacgagcagagtcaggctgggctcgagcatggcgactacctccacctgagcgggggggaggacgcgctcatcaagcatctggcccggcaggccatcatcgtcaaggatgcgctgctcgaccgcaccgaggtgcccctcagcgtggaggagctcagccgcgcctacgagctcaacctcttctcgccgcgcgtgccccccaagcgccagcccaacggcacctgcgagcccaacccgcgcctcaacttctacccggtcttcgcggtgcccgaggccctggccacctaccacatctttttcaagaaccaaaagatccccgtctcctgccgcgccaaccgcacccgcgccgacgcccttttgaacctgggccccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagatgcaggaccccgagagctccgaggagggcaagcccgtggtcagcgacgagcagctggcccggtggctgggtcctaatgctacccctcagagtttggaagagcggcgcaagctcatgatggccgtggtcctggtgaccgtggagctggagtgtctgcgccgcttcttcgccgacgcggagaccctgcgcaaggtcgaggagaacctgcactacatcttcaggcacgggttcgtgcgccaggcctgcaagatttccaacgtggagctgaccaacctggtctcctacatgggcatcttgcacgagaaccgactggggcagaacgtgctgcacaccaccctgcgcggggaggcccggcgcgactacatccgcgactgcgtctacctctacctctgccacacctggcagacgggcatgggcgtgtggcagcagtgcctggaggagcagaacctgaaagagctctgcaagctcctgcagaagaacctcaagggtctgtggaccgggttcgacgagcgcaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggcgagggatcggccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaattcttgctgaaaaagggccgcggggtctacctcgacccccagaccggtgaggagctcaaccccggcttcccccaggatgccccgaggaaacaagaagctgaaagtggagctgccgcccgtggaggatttggaggaagactgggagaacagcagtcaggcagaggaggaggagatggaggaagactgggacagcactcaggcagaggaggacagcctgcaagacagtctggaggaagacgaggaggaggcagaggaggaggtggaagaagcagccgccgccagaccgtcgtcctcggcgggggagaaagcaagcagcacggataccatctccgctccgggtcggggtcccgctcggccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtaaacttcccccgcaacatcttgcattactaccgtcacctccacagcccctactacttccaagaagaggcagcagcagaaaaagaccagcagaaaaccagcagcagctagaaaatccacagcggcggcagcgacaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccctcatcatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggccgtgctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcggatcttcagccagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaatcggtcactgaccttcaccgggaacgagaccgagctccagctccagtgtaagccccacaagaagtacctcacctggctgtaccagggctccccgatcgccgttgttaaccactgcgacgacgacggagtcctgctgaacggtcccgccaaccttactttttccacccgcagaagcaagctcgagctcttccaacccttcctccccgggacctatcagtgcatctcgggaccctgccatcacaccttccacctgatcccgaataccacctcttccccagcgccgctccccactaacaaccaaactaaccaccaccaacgctaccgacgcgacctcgttgaatctaataccacccacaccggaggtgagctccgaggtcctgaatcctctgggatttattacggcccctgggaggtggtggggttaatagctttaggcttagtagcgggtgggcttttggctctctgctacctatacctcccttgcttttcctacttagtggtgctttgttgctggtttaagaaatggggaagatcaccctagtgtgcggtgtgctggtgacggtggtgctttcgattctgggagggggaagcgcggctgtagtgacggagaagaaggccgatccctgcttgactttcaaccccgataaatgccggctgagttttcagcccgatggcaatcggtgcgcggtgttgatcaagtgcggatgggaatgcgagagtgtggcgattcagtataaaaacaagacgcggaacaatactctcgcgtccacatggcagcccggggaccccgagtggtacaccgtctctgtccctggtgctgacggctccctccgcacggtgaacaacactttcatttttgagcacatgtgcgaaaccgccatgttcatgagcaagcagtacggtatgtggcctccacgaaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacacacttttttcacacacctttttcagaccatggcctctgttaaagttttgatcatagtcagtttaattgcttatgcctctggctatgcaaacattaaaaaaaccctctatgttggttctgactctatattagagggtacccaatccggagctaaggtttcatggtatttttatagaaccacaactgatccagttaaactctgtaagggtgaattaccacgcacgcataaaactccacttacattcagctgcagcaataataatcttacacttttttcggtcactaaacaatatgctggcacttactacagcacaaattttcatactgggcaagataaatactatactattacagtggccgatccaaccactcctagaactactactaaacccaccacaactaaaaagcccactacacctaaaaagcctaccacacccaaaaccactaagacaacaactaagaccactaccacagagccaaccacaaccagcaccacacttgctataactacacacacggagctgacctcacaagcaactactgaaaatggttttgccctattgcaaaagggggataacagtagcagcagtcctctgcctactacccccagtgaggaaatacctaagtccatggttggcattatcgctgccgtagtggtgtgtatgctgattatcatcttgtgcatgatgtactatgcctgctactacagaaaacacaggctgaacaataagctggaccccctactgaatgttgatttttaattttttagaaccatgaagatcctaagcctttttgttttttctataattattacctctgctctatgcaattccaacgatgacgttactgtcgttgttggatccaattacacactgaaaggacctccaaaaggtatgctttcgtggtattgctggtttggaaacgatgagcaacaaacagagctctgcaatcttaaaaatggaaaagtctcaaacccaaaaatctccaattatatatgcaatggcactgatttaatactgctcaatatcacgaaagcatatgctggcagttatacttgtcctggagacaatgatgacatgatttttaaaaaattgattgtggttgatcccactaccccagcaccacccaccacaactaccaaggcacataccacagacacacaggaaaccactccagaggcagaagtagcagagttagcaaagcagattcatgaagattcctttgttgccaatacccccacacaccccggaccgcaatgtccagggccattagtcagcggcattgtcggtgtgctttgcgggttagcagttataatcatctgcatgttcatttttgcttgctgctacagaaggctccaccgacaaaaatcagacccactgctgaacctctatgtttaatttttgattttccagagccatgaaggcacttagcactttagtatttttgtccttgattggcattgtattcagtgctgggtttttgaaaaatcttaccattattgaaggcgaaaatgcaacactggtaggcatcagtggtcagaatgttagctggttaaaataccatctagatgggtggaaacctatttgcacctggaatgtcagtgtgtacacatgccatggtgttaacctcaccattaccaatgccacccaagatcagaatggcaggtttaagggtcagagttttactagcaacaatgggtatgaaacccataacatgttcatctatgatgtcactgtcatatcaaataagactacacctaccacccagacacccactacacacagctcaacacatgccatgcagaccactcagacaaccacatacactacatccactgaacccaccaccactacagcagaggtaaccagcacagcgcctcagccccaggcattggctttaagggctgcacagtctagcagcatgactgctaaaaccaatgagcagactactgaatttttgtccactactcagagtcgcaccacagctacctcgagtgccttctctagcaccgccaatctcacctcgctttcctctatgccaatcagtaatgctactaccctccccgctcctcttcccactcctctgaagcaatccgagtctagcacgcagctgcagatcaccctgctcattgtgatcggggtggtcatcctggcagtgctgctctactttatcttctgccgccgcatccccaacgcgaaaccggcctacaagcccattgttatcgggacgccggagccgcttcaggtggagggaggtctaaggaatcttctcttctcttttacagtatggtgatttgaactatgattcctagacatttcattatcacttctctaatctgtgtgctccaagtctgtgccaccctcgctctcgtggctaacgcgagtccagactgcattggagcgttcgcctcctacgtgctctttgccttcatcacctgcatctgctgctgtagcatagtctgcctgcttatcaccttcttccagttcattgactgggtctttgtgcgcatcgcctacctgcgccaccatccccagtaccgcgaccagagagtggctcaactgttgaggctcatctgatgataagcatgcgggctctgctactactcgcgcttgcactagctcccctcgccgcccccttctccctcaaatcccccacccaatcccctgaagaggttcgaaaatgtaaattccaagaaccctggaaattcctcaaatgctaccagctcaaatcagaaatgcaccccagctggatcatgatcattggaatcgtgaacatccttgcctgtaccctcatctcctttgtgatttacccctgctttaactttgggtggaacgcacccgaggcgctctggctcccgcctgatcccgacacaccaccacagcagcagcaaaatcaggcacatgcaccaccacagcctaggccacaatacatgcccatcttagactatgaggccgagccacagcgagccatgcttcctgctattagttacttcaatctaaccggcggagatgactgaccccatggccaacaacaccgtcaacgacctcctggacatggacggccgcgcctcggagcagcgactcgcccaactccgcatccgccagcagcaggagagagccgtcaaggagctgcaggatgcggtggccatccaccagtgcaagagaggcatcttctgcctggtgaaacaggccaagatctccttcgaggtcacttccaccgaccatcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccctgatcaagaccctctgcggcctccgcgacctcctccccatgaactaatcaactaacccactacccctttaccctccagtaaaaataaagattaaagagttgat

SEQ ID NO: 243 - protein, 188 aa, Artificial Sequence; identical to SEQ ID NO: 81
  Synthetic Construct

SEQ ID NO: 244 - protein, 211 aa, Artificial Sequence; identical to SEQ ID NO: 82
  Synthetic Construct

SEQ ID NO: 245 - protein, 134 aa, Artificial Sequence; identical to SEQ ID NO: 83
  Synthetic Construct

SEQ ID NO: 246 - DNA, 38528 bp, Artificial Sequence
  Simian adenovirus A1309 clone
  misc_feature (5)..(12): Swa\I
  repeat_region (16)..(144): ITR
  misc_feature (460)..(461): cleavage point for bottom strand
  misc_feature (464)..(465): cleavage point for top strand
  enhancer (814)..(1074): Enhancer
  misc_feature (1075)..(1302): CMV promoter
  TATA_signal (1276)..(1279): TATA
  CDS (1398)..(2489): Gag\short
  polyA_signal (2642)..(2844): BGH-PolyA
  misc_feature (2917)..(2955): PI-Scel recognition site
  misc_feature (2927)..(2928): cleavage point on bottom strand
  misc_feature (2931)..(2932): cleavage point on top strand
  CDS (2956)..(3345): E1b\55K
  CDS (3383)..(3853): pIX
  misc_feature (3918)..(5539): IVa2    complement (3918..5248,5527..5539)
  CDS (10777)..(11949): 52K
  CDS (11976)..(13742): pIIIa
  CDS (13824)..(15443): penton
  CDS (15450)..(16031): pVII
  CDS (16079)..(17122): V
  CDS (17150)..(17380): pX
  CDS (17452)..(18180): pVI
  CDS (18275)..(21091): hexon
  CDS (21116)..(21736): protease
  misc_feature (21825)..(23360): DBP    complement (21825..23360)
  CDS (23383)..(25770): 100K
  CDS (26396)..(27076): pVIII
  CDS (27080)..(27397): E3\12.5K
  CDS (27962)..(28492): E3\gp19K
  CDS (28525)..(29142): E3\CR1-beta
  CDS (29158)..(29772): E3\CR1-gamma
  CDS (30960)..(31391): E3\RID-beta
  CDS (32064)..(33338): fiber
  misc_feature (33450)..(34603): E4\orf6/7    complement (33450..33701,34433..34603)
  misc_feature (33701)..(34603): E4\orf6    complement (33701..34603)
  misc_feature (34512)..(34874): E4\orf4    complement (34512..34874)
  misc_feature (35237)..(35623): E4\orf2    complement (35237..35623)
  misc_feature (35666)..(36037): E4\orf1    complement (35666..36037)
  repeat_region (36327)..(36455): ITR    complement (36327..36455)
  misc_feature (36459)..(36466): Swa\I
  rep_origin (36704)..(36704): ORI
  misc_feature (37462)..(38325): AP(R)    complement (37462..38325)
aattatttaaatccccatcatcaataatatacctcaaacttttggtgcgcgttaatatgcaaatgaggtatttgaatttggggatgcggggcggtgattggctgcgggagcggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaattccgcgtttatggcagggaggagtatttgccgagggccgagtagactttgaccgattacgtgggggtttcgattaccgtatttttcacctaaatttccgcgtacgtaactataacggtcctaaggtagcgaaagctcagatctggatctcccgatcccctatggcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacagagagatgggtgcgagagcgtcagtattaagcgggggagaattagatcgatgggaaaaaattcggttaaggccagggggaaagaagaagtacaagctaaagcacatcgtatgggcaagcagggagctagaacgattcgcagttaatcctggcctgttagaaacatcagaaggctgtagacaaatactgggacagctacaaccatcccttcagacaggatcagaggagcttcgatcactatacaacacagtagcaaccctctattgtgtgcaccagcggatcgagatcaaggacaccaaggaagctttagacaagatagaggaagagcaaaacaagtccaagaagaaggcccagcaggcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaggacctgaacacgatgttgaacaccgtggggggacatcaagcagccatgcaaatgttaaaagagaccatcaatgaggaagctgcagattgggatagagtgcatccagtgcatgcagggcctattgcaccaggccagatgagagaaccaaggggaagtgacatagcaggaactactagtacccttcaggaacaaataggatggatgacaaataatccacctatcccagtaggagagatctacaagaggtggataatcctgggattgaacaagatcgtgaggatgtatagccctaccagcattctggacataagacaaggaccaaaggaaccctttagagactatgtagaccggttctataaaactctaagagctgagcaagcttcacaggaggtaaaaaattggatgacagaaaccttgttggtccaaaatgcgaacccagattgtaagaccatcctgaaggctctcggcccagcggctacactagaagaaatgatgacagcatgtcagggagtaggaggacccggccataaggcaagagttttgtagggatccactagttctagactcgagggggggcccggtacctttaagaccaatgacttacaaggcagctgtagatcttagccactttttaaaagaaaaggggggactggaagggctaattcactcccaaagaagacaagataaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcacatatgctggccactgtgcatgtgtcctcgcacccccgcaagacatggcccgagttcgagcacaacgtcatgacccgctgcaatgtgcacctgggctcccgccgaggcatgttcatgccctaccagtgcaacatgcaatttgtgaaggtgctgctggagcccgatgccatgtccagagtgagcctggcgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggaggtggagggcctgcatgaggggcagaatgactaaaatctgtgtttttctgcgcagcagcatgagcggaagcgcctcctttgagggaggggtattcagcccttatctgacggggcgtctcccctcctgggctggagtgcgtcagaatgtgatgggatccacggtggacggccggcccgtgcagcccgcgaactcttcaaccctgacctacgcgaccctgagctcctcgtccgtggacgcagctgccgccgcagctgctgcttcagccgccagcgccgtgcgcggaatggccctgggcgccggctactacagctctctggtggccaactcgagttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctattgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtggccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagcccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccaggggcgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtacagcttgggggcgaggaagacggactcgggggcgtaggcgtccgcgccgcagctggcgcagacggtctcgcactccacgagccaggtgaggtcggggcggtcggggtcaaaaacgaggtttcctccgtgctttttgatgcgtttcttacctctggtctccatgagctcgtgtccccgctgggtgacaaagaggctgtccgtgtccccgtagaccgactttatgggtcggtcttcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagatcgtccagcgccgcttgccagtcgcgcacggccagcgcgcgctcgtaggggctgaggggcgtgccccagggcatggggtgtgtgagcgcggaggcgtacatgccgcagatgtcgtagacgtagaggggctcttcgaggacgccgatgtaggtggggtagcagcgccccccgcggatgctggcgcgcacgtagtcgtacagctcgtgcgagggcgcgaggagccccgtgccgagattggagcgctgcggcttttcggcgcggtagacgatctggcggaagatggcgtgggagttggaggagatggtgggcctctggaagatgttgaagtgggcgtggggcaggccgaccgagtccctgatgaagtgggcgtaggagtcttgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaagcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagagcccagtcggcgaggtgggggttggcactgaggaaggaagaccagagatccacggccagggcggtctgcaagcggtcccggtactgacggaactgccggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctcgtgctgtactacgtcctggccatcggcgtggccatcgtctgcctcgatggtggtcatgctgacgaggccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgttttttcttgggcgctggcggcggcggctccatgcttagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtagaagtccacggcgaagttgaaaaactgggagttgcgcgccgagacggtcaactcctcctccagaagacggatgagctcggcgatggtggcgcgcacctcgcgctcgaaggccccggggggctcctcctcttccatctcctcctcctcttcctcctccactaacatctcttctacttcctcctcaggaggcggcggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattgacccgtagggactccgcgcaaggacctgagcgtctcgagatccacgggatccgaaaaccgctgaacgaaggcttcgagccagtcgcagtcgcaaggtaggctgagcccggtttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctgtggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgttcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgttttggcaattttcgtcaggccggaaatgaaactagtaagcgcggaaagcggccgcccgcgatggctcgctgccgtagtctggagaaagaatcgccagggttgcgttgcggtgtgccccggttcgagactcagcgctcggcgccggccggattccgcggctaacgtgggcgtggctgccccgtcgtttccaagaccccttagccagccgacttctccagttacggagcgagcccctctttttcttgtgtttttgccagatgcatcccgtactgcggcagatgcgcccccaccctccaccacaaccgcccctaccgcagcagcagcaacagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggatcgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcacgctgatcgcgcgcgaggaggtgaccctgggcctgatgcacctgtgggacctgctggaggccattgtgcagaatcccacgagcaagccgctgacggcgcagctgtttctggtggtgcagcacagtcgggacaacgagacgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagcctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggcgtgccctacgtggaggaggtggacgatgaggaggaggagggcgagtacctggaagactgatggcgcgaccgtatttttgctagatgcagcaacagccaccgccgccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggcgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcgggcaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgccgcgctcgacatgaccgcgcgcaacatggagcccagcatgtacgcccgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgccccaccaccaccgtgtggaagaaagagggcggggaccggcggccgtcctcggcgctgtccggtcgcgcgggtgctgccgcggcggtgcccgaggccgccagccccttcccgagcctgcccttttcgctgaacagcgtgcgcagcagcgagctgggtcggctgacgcggccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcagcgcaggcgccacccgtagacgccagcggcacgacaggcagcggggtctggtgtgggacgatgaggattccgccgacgacagcagcgtgttggacttgggtgggagtggtggtggtaacccgttcgctcacctgcgcccccgcatcgggcgcctgatgtaagaatctgaaaaaataaaaaacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaacggggtcacggtaggggatgattatgatggtagtcaggacgagctgacctacgagtgggtggagtttgagctgcccgagggcaacttctcggtgaccatgaccatcgatctgatgaacaacgccatcatcgacaactacttggcggtggggcggcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctacgagaaaagcaaggaggatagcgccgcagcggcgaccgcagccgtggctaccgccgcgactgtggcagatgccactgtcaccaggggcgatacattcgccacccaggcggaggaagcagccgccctagcggcgaccgatgatagtgaaagtaagatagttatcaagccggtggagaaggacagcaaggacaggagctacaacgttctatcggatggaaagaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaattcaaggaagagatgctccaggtcatcgcgcctgagatctacggcccggctgcggtgaaggaggaaagaaagccccgcaaactgaagcgggtcaaaaaggacaaaaaggaggaggaagatgacggactggtggagtttgtgcgcgagttcgccccccggcggcgcgtgcagtggcgcgggcggaaagtgaaaccggtgctgcgacccggcaccacggtggtcttcacgcccggcgagcgttccggctccgcctccaagcgctcctacgacgaggtgtacggggacgaggacatcctcgagcaggcggccgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggtgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcgccggcctccaccaccaccactcgccgaagacgcaagtacggcgcggccagcctgctgatgcccaactacgcgctgcatccttccatcatccccacgccgggctaccgcggcacgcgcttctaccgcggctacaccagcagcagccgccgcaagaccaccacccgccgccgccgtcgtcgcacccgccgcagcagcaccgcgacttccgccgccgccctggtgcggagagtgtaccgcagcgggcgcaagcctctgaccctgccgcgcgcgcgctaccacccgagcatcgccatttaactctgccgtcgcctccttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggtctgcccaccacgcgccccgtggcgcctctggccaccggggtgctgaaacccagcagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtgtatatgtatgtccgccgaccagaaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccccagcttcaaaccctactccggcaccgcctacaacagcctggctcccaaggctgctcctaatccgagccagtgggaagaaaccactgcaggaacaaatgggaatgccgatgccactactaccactcatagctttggactggctgctatgaagggggacaacattacatctgatggtttgcagataggaacggatgctagttctggagaagaaaaacccatctatgcagataaactgtaccagccagaaccccaaataggggaagagtcatggaccgatactgatggaaccaatgaaaaatttggaggaagagtccttaaaaaggacacaagcatgaagccttgctatgggtcatttgccaaacccactaataacaaaggtggacaggcaaaacaaaaggcaactgaaggaactgatatagagtatgatgttgacatgaaatttttcgatggtagggatgcggctgctaactttactccagaagtagtgttgtatgctgaaaatgttgatctggaaactccagatacccacattgtatacaaaccaggaacctctgatgtaagttcccatgttaatttgggacaacagtctatgcccaacagacccaactacattggcttcagagacaactttatcggtctcatgtactacaacagcactggcaatatgggtgtactggctggtcaggcctcccagctgaatgctgtggtggacttgcaggacagaaacaccgaactgtcctaccagctcttgcttgactctctgggtgacagaaccaggtatttcagtatgtggaatcaggcggtggacagctatgaccccgatgtgcgcattattgaaaaccatggtatagaagacgaacttcccaactattgcttccctctggatgctgtgggtattaccagaacctatcaaggcatcaaattgcaaaatggtcaaactaccacctgggaaaaggatgacagcgttagcactgccaatgaaataggaattggcaacaatctggccatggagatcaacatccaggccaacctgtggcggaacttcctctacgcgaacgtggccctgtacctgcccgactcctacaagtacacgccggccaacatcacgctgccgaccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccattccggccaacgccaccaacgtgcccatctccatcccctcgcgcaactgggccgccttccgcggctggtcattcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagagggatacaacgtggctcagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagccgctcttgcttcttgcaagatgacggcctgtggctccggcgagcaggagctcagggccatcctccgcgacctgggctgcgggccctacttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaaaaaaccggtgtgtgtatgtgaatgctttattcataataaacagcacatgtttatgccaccttttctgaggctctgactttatttagaaatcgaaggggttctgccggctctcggcatgccccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcacagttgggacccgcgttctgcgcgcgagagttgcggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagcccgcgtcgtgcacgcagcagcgcgcgtcgttgttggccagctgcaccacgctgcgcccccagcggttctgggtaatcttggcccggtcggggttctccttcagcgcgcgctgcccgttctcgctcgccacatccatctcgatcgtgtgctccttctggatcatcacggtcccgtgcaggcaccgcagcttgccctcggcctcggtgcagccgtgcagccacagcgcgcagccggtgcactcccagttcttgtgggcgatctgggagtgcgagtgcacgaagccctgcaggaagcggcccatcatcgtagtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgtcatcttagtcgccgccgccgaggtcagggggtcgttctcgtccagggtttcaaacactcgcttgccgtccttctcggtgatgcgcacggggggaaagctgaagcccacggccgccagctcctcctcggcctgcctttcgtcctcgctgtcctggctgatgtcttgtaaaggcacatgcttggtcttgcggggtttctttttgggcggcagaggcggcggcggcggagacgtgctgggcgagcgcgagttctcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaagcatggagactcagccatcgtcgccaacatcgccatctgcccccgccgccgacgagaaccagcagcagaatgaaagcttaaccgccccgccgcccagccccacctccgacgcggccccagacatgcaagagatggaggaatccatcgagattgacctgggctacgtgacgcccgcggagcacgaggaggagctggcagcgcgcttttcagccccggaagagaaccaccaagagcagccagagcaggaagcagagagcgagcagcagcaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacctctttttcaagaatcaaaggatccccgtctcctgccgcgccaaccgcacccgcgccgacgccctactcaacctgggccccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtactcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgtctggaggagcagaacctgaaagagctctgcaagctcctgcagaagaacctcaaggccctgtggaccgggttcgacgagcgcaccaccgccgcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacctgctgcgtctggctaactacctggcctaccactcggacgtgatcgaggacgtcagcggcgagggtctgctcgagtgccactgccgctgcaacctctgcacgccgcaccgctccctggcctgcaacccccagctgctgagcgagacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggtcgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccggaggatttggaggaagactgggagagcagtcaggcagaggaggagatggaagactgggacagcactcaggcagaggaggacagcctgcaagacagtctggaggaggaagacgaggtggaggaggaggcagaggaagaagcagccgccgccagaccgtcgtcctcggcggaggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagaaaaccagcggcagcagcagctagaaaatccacggcggcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcggctgacctagctcggcttcgacacctggaccactgccgccgcttccgctgcttcgctcgggatctcgccgagtttgcctactttgagctgcccgaggagcaccctcagggtccggcccacggagtgcggatcatcgtcgaagggggcctcgactcccacctgcttcggatcttcagccagcgaccgatcctggtcgagcgcgagcaaggacagacccgtctgaccctgtattgcatctgcaaccaccccggcctgcatgaaagtctttgttgtctgctgtgtactgagtataataaaagctgagatcagcgactactctggactcgattgtggtgttcctgctatcaaccggtccctgttcttcaccggaaacgagaccgagctccagctccagtgtaagccccacaagaagtacctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcggcgctccccgctactaacaaccaaactacccaccaacgccaccgtcgcgacctttcctctgaatctaataccacccacaccggaggtgagctccgaggtcgaccaacctctgggatttactacggcccctgggaggtggtggggttaatagcgctaggcctagttgcgggtgggcttttggttctctgctacctatacctcccttgctgttcgtacttagtggtgctgtgttgctggtttaagaaatggggaagatcaccctagtgagctgcggtgcgctggtggcggtggtgctttcgattatgggactgggcggcgcggctgtagtgaaggaggagaaggccgatccctgcttgcatttcaatcccgacaaatgccagctgagttttcaggccgatggcaatcggtgcgcggtgctgatcaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaataatactttcatttttgcacacatgtgcgacacggtcatgtggatgagcaagcagtacgatatgtggccccccacgaaggagaacatcgtggtcttctccatcgcttacagcctgtgcacggtgctaatcaccgctatcgtgtgcctgagcattcacatgctcatcgctattcgccccagaaataatgccgagaaagaaaaacagccataacacgttttttcacacacctttttcagaccatggcctctgttaaatttttgcttttatttgccagtctcattgccgtcattcatggaatgagtaatgagaaaattactatttacactggcactaatcacacattgaaaggtccagaaaaagccacagaagtttcatggtattgttattttaatgaatcagatgtatctactgaactctgtggaaacaataacaaaaaaaatgagagcattactctcatcaagtttcaatgtggatctgacttaaccctaattaacatcactagagactatgtaggtatgtattatggaactacagcaggcatttcggacatggaattttatcaagtttctgtgtctgaacccaccacgcctagaatgaccacaaccacaaaaactacacctactaccaccacacagctcactaccaatggctttcttgccatgcttcgagtggctgaaaatagcaccagcattcaacccaccccacccagtgaggaaattcccagatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctaggccttttagttttttctatcattacctctgctctatgcaattctgacaatgaggacgttactgtcgttgtcggatcaaattatacactgaaaggtccagcgaagggtatgctttcgtggtattgctattttggatctgacactacagaaactgaattatgcaatcttaagaatggcaaaattcaaaattctaaaattaacaattatatatgcaatggtactgatctgatactcctcaatgtcacgaaagcatattctggcagctacacctgccctggagatgatgctgacaatatgattttttacaaagtggaagtggttgatcccactactccacctccacccaccaccacaaccactcataccacacacacagaacaaaccacagcagaggaggtagcaaagttagccttgcaggtccaaggcagttcatttgttggcattacccctacacccgatcagcggtgtccggggctgctcgtcagcggcattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcactctagttttttgttctttgattggcactgtttttagtgttagctttttgaaacaaattaatgttactgagggggaaaatgtgacactggtaggcgtagaaggtgctcaaaataccacctggacaaaataccacctcgatgggtggaaagatatttgcaattggagtgtcattacttacacatgtgagggagttaatttgaccatagtcaatgccagccaaaatcagaagggttggattaaagggcaatctgttagtgttaccagtgaggggtactatacccagcatactcttatctatgacattatagtcataccgctgcctacgcctagcccacctagcactaccacacagacaacccacactacacacacaaccacatacagtacatcaaatcagcctaccaccactacagcagcagaggttgccagctcgtctggagtccaagtggcatttttgttgttgcccccatctagcagtcccactgctagtaccaatgagcagactactgaatttttgtccactgtcgagagccacaccgcagctacctccagtgccttctctagcaccgccaatctctcctcgctttcctctacaccaatcagtcccgctactactactcctacccccgctcttctccccactcccctgaagcaaactgaggacggcggcatgcaatggcagatcaccctgctcattgtgatcgggttggtcatcctggccgtgttgctctactacatcttctgccgccgcattcccaacgcgcaccgcaagccggtctacaagcccatcgttgtcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcatcacctgcatctgctgctgtagcatagtctgcctgcttatcaccttcttccagttcattgactggatctttgtgcgcatcgcctacctgcgccaccacccccagtaccgcgaccagcgagtggcgcggctgctcaggatcctctgataagcatgcgggctctgctacttctcgcgcttctgctgttagtgctcccccgtcccgtcgacccccggacccccacccagtcccccgaggaggtccgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcaacctcaggcacacgcactaccaccaccaccacagcctaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaaaaaataatcatttgatttgaaataaagatacaatcatattgatgatttgagtttaacaaaaataaagaatcacttacttgaaatctgataccaggtctctgtccatattttctgccaacaccacctcactcccctcttcccagctctggtactgcaggccccggcgggctgcaaacttcctccacacgctgaaggggatgtcaaattcctcctgcccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggccgaccccgtcaccaccaagaacggggaaatcaccctcaagctgggagagggggtggacctcgactcctcgggaaaactcatctccaacacggccaccaaggccgctgcccctctcagtttttccaacaacaccatttcccttaacatggatcaccccttttacactaaagatggaaaattagccttacaagtttctccaccattaaatatactgagaacaagcattctaaacacactagctttaggttttggatcaggtttaggactccgtggctctgccttggcagtacagttagtctctccacttacatttgatactgatggaaacataaagcttaccttagacagaggtttgcatgttacaacaggagatgcaattgaaagcaacataagctgggctaaaggtttaaaatttgaagatggagccatagcaaccaacattggaaatgggttagagtttggaagcagtagtacagaaacaggtgtcgatgatgcttacccaatccaagttaaacttggatctggccttagctttgacagtacaggagccataatggctggtaacaaagaagacgataaactcactttgtggacaacacctgatccatcaccaaactgtcaaatactcgcagaaaatgatgcaaaactaacactttgcttgactaaatgtggtagtcaaatactggccactgtgtcagtcttagttgtaggaagtggaaacctaaaccccattactggcaccgtaagcagtgctcaggtgtttctacgttttgatgcaaacggtgttcttttaacagaacattctacactaaaaaaatactgggggtataggcagggagatagcatagatggcactccatatgccaatgctgtaggattcatgcccaatttaaaagcttatccaaagtcacaaagttctactactaaaaataatatagtagggcaagtatacatgaatggagatgtttcaaaacctatgcttctcactataaccctcaatggtactaatgacagcaacagtacatattcaatgtcattttcatacacctggactaatggaagctatgttggagcaacatttggagctaactcttataccttctcctacatcgcccaagaatgaatactgtatcccaccctgcatgcccaaccctcccccacctctgtctatatggaaaactctgaaacacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgccccctccagaacacgctgcccatgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcagctcctcgggggtcaaaaccatatcccagggcacgggaaactcttgcaggacagcgaagcccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgatcgtgtcatgatgcagttgctttcggacattttcgtacttgctgtagcagaacctggtccgggcgctgcacaccgatcgccggcggcggtcccggcgcttggaacgctcggtgttgaagttgtaaaacagccactctctcagaccgtgcagcagatctagggcctcaggagtgatgaaaatcccatcatgcctgatggctctgatcacatcgaccaccgtggaatgggccagacccagccagatgatgcaattttgttgggtttcggtgacggcgggggagggaagaacaggaagaaccatgattaacttttaatccaaacggtctcggagtacttcaaaatgaaggtcgcggagatggcacctctcgcccccgctgtgttggtggaaaataacagccaggtcaaaggtgatacggttctcgagatgttccacggtggcttccagcaaagcctccacgcgcacatccagaaacaagacaatagcaaaagcgggagggttctctaattcctcaatcatcatgttacactcctgcaccatccccagataattttcatttttccagccttgaatgattcgaactagttcctgaggtaaatccaagccagccattataaagagctcgcgcagagcgccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcctctccgaaatttttagccataggaccgccaggaataagattagggcaagccacagtacagataaaccgaagtcctccccagtgagcattgccaaatgcaagactgctataagcatgctggctagacccggtgatatcttccagataactggacagaaaatcgcccaggcaatttttaagaaaatcaacaaaagaaaaatcctccaggtgcacgtttagagcctcgggaacaacgatggagtaaatgcaagcggtgcgttccagcatggttagttagctgatctgtagaaaaaacaaaaatgaacattaaaccatgctagcctggcgaacaggtgggtaaatcgttctctccagcaccaggcaggccacggggtctccggcgcgtccctcataaaaattgtcgctatgattgaaaaccatcacagagagacgttcccggtggccggcgtgaatgattcgacaagacgaatacacccccggaacattggcgtccgcgagtgaaaaaaagcgcccaaggaagcaataaggcactacaatgctcagtctcaagtccagcaaagcgatgccatgcggatgaagcacaaaattctcaggtgcgtacaaaatgtaattactcccctcctgcacaggcagcaaagcccccgatccctccaggtacacatacaaagcctcagcgtccatagcttaccgagcagcagcagcggcacacaacaggcgcaagagtcagagaaaggctgagctctaacctgtccacccgctctctgctcaatatatagcccagatctacactgacgtaaaggccaaagtctaaaaatacccgccaaataatcacacacgcccagcacacgcccagaaaccggtgacacactcagaaaaatacgcgcacttcctcaaacgcccaaactgccgtcatttccgggttcccacgctacgtcatcaaaacacgactttcaaattccgtcgaccgttaaaaacgtcacccgccccgcccctaacggtcgccgctcccgcagccaatcaccgccccgcatccccaaattcaaatacctcatttgcatattaacgcgcaccaaaagtttgaggtatattattgatgatgatcatttaaatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaag

SEQ ID NO: 247 - protein, 363 aa, Artificial Sequence; identical to SEQ ID NO: 169
  Synthetic Construct

SEQ ID NO: 248 - protein, 130 aa, Artificial Sequence
  Synthetic Construct
HMLATVHVSSHPRKTWPEFEHNVMTRCNVHLGSRRGMFMPYQCNMQFVKVLLEPDAMSRVSLAGVFDMNVELWKILRYDESKTRCRACECGGKHARLQPVCVEVTEDLRPDHLVLSCNGTEFGSSGEESD

SEQ ID NO: 249 - protein, 157 aa, Artificial Sequence; identical to SEQ ID NO: 88
  Synthetic Construct

SEQ ID NO: 250 - protein, 391 aa, Artificial Sequence; identical to SEQ ID NO: 89
  Synthetic Construct

SEQ ID NO: 251 - protein, 589 aa, Artificial Sequence; identical to SEQ ID NO: 90
  Synthetic Construct

SEQ ID NO: 252 - protein, 540 aa, Artificial Sequence; identical to SEQ ID NO: 91
  Synthetic Construct

SEQ ID NO: 253 - protein, 194 aa, Artificial Sequence; identical to SEQ ID NO: 34
  Synthetic Construct

SEQ ID NO: 254 - protein, 348 aa, Artificial Sequence; identical to SEQ ID NO: 93
  Synthetic Construct

SEQ ID NO: 255 - protein, 77 aa, Artificial Sequence; identical to SEQ ID NO: 36
  Synthetic Construct

SEQ ID NO: 256 - protein, 243 aa, Artificial Sequence; identical to SEQ ID NO: 95
  Synthetic Construct

SEQ ID NO: 257 - protein, 939 aa, Artificial Sequence; identical to SEQ ID NO: 96
  Synthetic Construct

SEQ ID NO: 258 - protein, 207 aa, Artificial Sequence; identical to SEQ ID NO: 97
  Synthetic Construct

SEQ ID NO: 259 - protein, 796 aa, Artificial Sequence; identical to SEQ ID NO: 98
  Synthetic Construct

SEQ ID NO: 260 - protein, 227 aa, Artificial Sequence; identical to SEQ ID NO: 99
  Synthetic Construct

SEQ ID NO: 261 - protein, 106 aa, Artificial Sequence; identical to SEQ ID NO: 100
  Synthetic Construct

SEQ ID NO: 262 - protein, 177 aa, Artificial Sequence; identical to SEQ ID NO: 101
  Synthetic Construct

SEQ ID NO: 263 - protein, 206 aa, Artificial Sequence; identical to SEQ ID NO: 102
  Synthetic Construct

SEQ ID NO: 264 - protein, 205 aa, Artificial Sequence; identical to SEQ ID NO: 103
  Synthetic Construct

SEQ ID NO: 265 - protein, 144 aa, Artificial Sequence; identical to SEQ ID NO: 48
  Synthetic Construct

SEQ ID NO: 266 - protein, 425 aa, Artificial Sequence; identical to SEQ ID NO: 106
  Synthetic Construct

SEQ ID NO: 267 - DNA, 31800 bp, Artificial Sequence
  Simian adenovirus A1309 clone
  CDS (25487)..(26056): 22K
  CDS (27354)..(27977): E3\CR1-alpha
  CDS (29790)..(30668): E3\CR1-delta
  CDS (31387)..(31791): E3\14.7K
aattatttaaatccccatcatcaataatatacctcaaacttttggtgcgcgttaatatgcaaatgaggtatttgaatttggggatgcggggcggtgattggctgcgggagcggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaattccgcgtttatggcagggaggagtatttgccgagggccgagtagactttgaccgattacgtgggggtttcgattaccgtatttttcacctaaatttccgcgtacgtaactataacggtcctaaggtagcgaaagctcagatctggatctcccgatcccctatggcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacagagagatgggtgcgagagcgtcagtattaagcgggggagaattagatcgatgggaaaaaattcggttaaggccagggggaaagaagaagtacaagctaaagcacatcgtatgggcaagcagggagctagaacgattcgcagttaatcctggcctgttagaaacatcagaaggctgtagacaaatactgggacagctacaaccatcccttcagacaggatcagaggagcttcgatcactatacaacacagtagcaaccctctattgtgtgcaccagcggatcgagatcaaggacaccaaggaagctttagacaagatagaggaagagcaaaacaagtccaagaagaaggcccagcaggcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaggacctgaacacgatgttgaacaccgtggggggacatcaagcagccatgcaaatgttaaaagagaccatcaatgaggaagctgcagattgggatagagtgcatccagtgcatgcagggcctattgcaccaggccagatgagagaaccaaggggaagtgacatagcaggaactactagtacccttcaggaacaaataggatggatgacaaataatccacctatcccagtaggagagatctacaagaggtggataatcctgggattgaacaagatcgtgaggatgtatagccctaccagcattctggacataagacaaggaccaaaggaaccctttagagactatgtagaccggttctataaaactctaagagctgagcaagcttcacaggaggtaaaaaattggatgacagaaaccttgttggtccaaaatgcgaacccagattgtaagaccatcctgaaggctctcggcccagcggctacactagaagaaatgatgacagcatgtcagggagtaggaggacccggccataaggcaagagttttgtagggatccactagttctagactcgagggggggcccggtacctttaagaccaatgacttacaaggcagctgtagatcttagccactttttaaaagaaaaggggggactggaagggctaattcactcccaaagaagacaagataaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcacatatgctggccactgtgcatgtgtcctcgcacccccgcaagacatggcccgagttcgagcacaacgtcatgacccgctgcaatgtgcacctgggctcccgccgaggcatgttcatgccctaccagtgcaacatgcaatttgtgaaggtgctgctggagcccgatgccatgtccagagtgagcctggcgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggaggtggagggcctgcatgaggggcagaatgactaaaatctgtgtttttctgcgcagcagcatgagcggaagcgcctcctttgagggaggggtattcagcccttatctgacggggcgtctcccctcctgggctggagtgcgtcagaatgtgatgggatccacggtggacggccggcccgtgcagcccgcgaactcttcaaccctgacctacgcgaccctgagctcctcgtccgtggacgcagctgccgccgcagctgctgcttcagccgccagcgccgtgcgcggaatggccctgggcgccggctactacagctctctggtggccaactcgagttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctattgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtggccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagcccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccaggggcgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtacagcttgggggcgaggaagacggactcgggggcgtaggcgtccgcgccgcagctggcgcagacggtctcgcactccacgagccaggtgaggtcggggcggtcggggtcaaaaacgaggtttcctccgtgctttttgatgcgtttcttacctctggtctccatgagctcgtgtccccgctgggtgacaaagaggctgtccgtgtccccgtagaccgactttatgggtcggtcttcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagatcgtccagcgccgcttgccagtcgcgcacggccagcgcgcgctcgtaggggctgaggggcgtgccccagggcatggggtgtgtgagcgcggaggcgtacatgccgcagatgtcgtagacgtagaggggctcttcgaggacgccgatgtaggtggggtagcagcgccccccgcggatgctggcgcgcacgtagtcgtacagctcgtgcgagggcgcgaggagccccgtgccgagattggagcgctgcggcttttcggcgcggtagacgatctggcggaagatggcgtgggagttggaggagatggtgggcctctggaagatgttgaagtgggcgtggggcaggccgaccgagtccctgatgaagtgggcgtaggagtcttgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaagcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagagcccagtcggcgaggtgggggttggcactgaggaaggaagaccagagatccacggccagggcggtctgcaagcggtcccggtactgacggaactgccggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctcgtgctgtactacgtcctggccatcggcgtggccatcgtctgcctcgatggtggtcatgctgacgaggccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgttttttcttgggcgctggcggcggcggctccatgcttagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtagaagtccacggcgaagttgaaaaactgggagttgcgcgccgagacggtcaactcctcctccagaagacggatgagctcggcgatggtggcgcgcacctcgcgctcgaaggccccggggggctcctcctcttccatctcctcctcctcttcctcctccactaacatctcttctacttcctcctcaggaggcggcggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattgacccgtagggactccgcgcaaggacctgagcgtctcgagatccacgggatccgaaaaccgctgaacgaaggcttcgagccagtcgcagtcgcaaggtaggctgagcccggtttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctgtggctggacgagcgccaggtcggcgacgacgcgctcggcgaggatggcctgctggatctgggtgagggtggtctggaagtcgtcgaagtcgacgaagcggtggtaggctccggtgttgatggtgtaggagcagttggccatgacggaccagttgacggtctggtggccggggcgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgttcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgagtccctgctcgaatcaggctggagccgcagctaacgtggtactggcactcccgtctcgacccaagcctgctaacgaaacctccaggatacggaggcgggtcgttttggcaattttcgtcaggccggaaatgaaactagtaagcgcggaaagcggccgcccgcgatggctcgctgccgtagtctggagaaagaatcgccagggttgcgttgcggtgtgccccggttcgagactcagcgctcggcgccggccggattccgcggctaacgtgggcgtggctgccccgtcgtttccaagaccccttagccagccgacttctccagttacggagcgagcccctctttttcttgtgtttttgccagatgcatcccgtactgcggcagatgcgcccccaccctccaccacaaccgcccctaccgcagcagcagcaacagccggcgcttctgcccccgccccagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggatcgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcacgctgatcgcgcgcgaggaggtgaccctgggcctgatgcacctgtgggacctgctggaggccattgtgcagaatcccacgagcaagccgctgacggcgcagctgtttctggtggtgcagcacagtcgggacaacgagacgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagcctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggcgtgccctacgtggaggaggtggacgatgaggaggaggagggcgagtacctggaagactgatggcgcgaccgtatttttgctagatgcagcaacagccaccgccgccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggcgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcgggcaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgccgcgctcgacatgaccgcgcgcaacatggagcccagcatgtacgcccgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgccccaccaccaccgtgtggaagaaagagggcggggaccggcggccgtcctcggcgctgtccggtcgcgcgggtgctgccgcggcggtgcccgaggccgccagccccttcccgagcctgcccttttcgctgaacagcgtgcgcagcagcgagctgggtcggctgacgcggccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcagcgcaggcgccacccgtagacgccagcggcacgacaggcagcggggtctggtgtgggacgatgaggattccgccgacgacagcagcgtgttggacttgggtgggagtggtggtggtaacccgttcgctcacctgcgcccccgcatcgggcgcctgatgtaagaatctgaaaaaataaaaaacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaacggggtcacggtaggggatgattatgatggtagtcaggacgagctgacctacgagtgggtggagtttgagctgcccgagggcaacttctcggtgaccatgaccatcgatctgatgaacaacgccatcatcgacaactacttggcggtggggcggcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctacgagaaaagcaaggaggatagcgccgcagcggcgaccgcagccgtggctaccgccgcgactgtggcagatgccactgtcaccaggggcgatacattcgccacccaggcggaggaagcagccgccctagcggcgaccgatgatagtgaaagtaagatagttatcaagccggtggagaaggacagcaaggacaggagctacaacgttctatcggatggaaagaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaattcaaggaagagatgctccaggtcatcgcgcctgagatctacggcccggctgcggtgaaggaggaaagaaagccccgcaaactgaagcgggtcaaaaaggacaaaaaggaggaggaagatgacggactggtggagtttgtgcgcgagttcgccccccggcggcgcgtgcagtggcgcgggcggaaagtgaaaccggtgctgcgacccggcaccacggtggtcttcacgcccggcgagcgttccggctccgcctccaagcgctcctacgacgaggtgtacggggacgaggacatcctcgagcaggcggccgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggtgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcgccggcctccaccaccaccactcgccgaagacgcaagtacggcgcggccagcctgctgatgcccaactacgcgctgcatccttccatcatccccacgccgggctaccgcggcacgcgcttctaccgcggctacaccagcagcagccgccgcaagaccaccacccgccgccgccgtcgtcgcacccgccgcagcagcaccgcgacttccgccgccgccctggtgcggagagtgtaccgcagcgggcgcaagcctctgaccctgccgcgcgcgcgctaccacccgagcatcgccatttaactctgccgtcgcctccttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggtctgcccaccacgcgccccgtggcgcctctggccaccggggtgctgaaacccagcagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtgtatatgtatgtccgccgaccagaaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccccagcttcaaaccctactccggcaccgcctacaacagcctggctcccaaggctgctcctaatccgagccagtgggaagaaaccactgcaggaacaaatgggaatgccgatgccactactaccactcatagctttggactggctgctatgaagggggacaacattacatctgatggtttgcagataggaacggatgctagttctggagaagaaaaacccatctatgcagataaactgtaccagccagaaccccaaataggggaagagtcatggaccgatactgatggaaccaatgaaaaatttggaggaagagtccttaaaaaggacacaagcatgaagccttgctatgggtcatttgccaaacccactaataacaaaggtggacaggcaaaacaaaaggcaactgaaggaactgatatagagtatgatgttgacatgaaatttttcgatggtagggatgcggctgctaactttactccagaagtagtgttgtatgctgaaaatgttgatctggaaactccagatacccacattgtatacaaaccaggaacctctgatgtaagttcccatgttaatttgggacaacagtctatgcccaacagacccaactacattggcttcagagacaactttatcggtctcatgtactacaacagcactggcaatatgggtgtactggctggtcaggcctcccagctgaatgctgtggtggacttgcaggacagaaacaccgaactgtcctaccagctcttgcttgactctctgggtgacagaaccaggtatttcagtatgtggaatcaggcggtggacagctatgaccccgatgtgcgcattattgaaaaccatggtatagaagacgaacttcccaactattgcttccctctggatgctgtgggtattaccagaacctatcaaggcatcaaattgcaaaatggtcaaactaccacctgggaaaaggatgacagcgttagcactgccaatgaaataggaattggcaacaatctggccatggagatcaacatccaggccaacctgtggcggaacttcctctacgcgaacgtggccctgtacctgcccgactcctacaagtacacgccggccaacatcacgctgccgaccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccattccggccaacgccaccaacgtgcccatctccatcccctcgcgcaactgggccgccttccgcggctggtcattcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagagggatacaacgtggctcagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagccgctcttgcttcttgcaagatgacggcctgtggctccggcgagcaggagctcagggccatcctccgcgacctgggctgcgggccctacttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaaaaaaccggtgtgtgtatgtgaatgctttattcataataaacagcacatgtttatgccaccttttctgaggctctgactttatttagaaatcgaaggggttctgccggctctcggcatgccccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcacagttgggacccgcgttctgcgcgcgagagttgcggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagcccgcgtcgtgcacgcagcagcgcgcgtcgttgttggccagctgcaccacgctgcgcccccagcggttctgggtaatcttggcccggtcggggttctccttcagcgcgcgctgcccgttctcgctcgccacatccatctcgatcgtgtgctccttctggatcatcacggtcccgtgcaggcaccgcagcttgccctcggcctcggtgcagccgtgcagccacagcgcgcagccggtgcactcccagttcttgtgggcgatctgggagtgcgagtgcacgaagccctgcaggaagcggcccatcatcgtagtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgtcatcttagtcgccgccgccgaggtcagggggtcgttctcgtccagggtttcaaacactcgcttgccgtccttctcggtgatgcgcacggggggaaagctgaagcccacggccgccagctcctcctcggcctgcctttcgtcctcgctgtcctggctgatgtcttgtaaaggcacatgcttggtcttgcggggtttctttttgggcggcagaggcggcggcggcggagacgtgctgggcgagcgcgagttctcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaagcatggagactcagccatcgtcgccaacatcgccatctgcccccgccgccgacgagaaccagcagcagaatgaaagcttaaccgccccgccgcccagccccacctccgacgcggccccagacatgcaagagatggaggaatccatcgagattgacctgggctacgtgacgcccgcggagcacgaggaggagctggcagcgcgcttttcagccccggaagagaaccaccaagagcagccagagcaggaagcagagagcgagcagcagcaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacctctttttcaagaatcaaaggatccccgtctcctgccgcgccaaccgcacccgcgccgacgccctactcaacctgggccccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtactcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgtctggaggagcagaacctgaaagagctctgcaagctcctgcagaagaacctcaaggccctgtggaccgggttcgacgagcgcaccaccgccgcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacctgctgcgtctggctaactacctggcctaccactcggacgtgatcgaggacgtcagcggcgagggtctgctcgagtgccactgccgctgcaacctctgcacgccgcaccgctccctggcctgcaacccccagctgctgagcgagacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggtcgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccggaggatttggaggaagactgggagagcagtcaggcagaggaggagatggaagactgggacagcactcaggcagaggaggacagcctgcaagacagtctggaggaggaagacgaggtggaggaggaggcagaggaagaagcagccgccgccagaccgtcgtcctcggcggaggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagaaaaccagcggcagcagcagctagaaaatccacggcggcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcggctgacctagctcggcttcgacacctggaccactgccgccgcttccgctgcttcgctcgggatctcgccgagtttgcctactttgagctgcccgaggagcaccctcagggtccggcccacggagtgcggatcatcgtcgaagggggcctcgactcccacctgcttcggatcttcagccagcgaccgatcctggtcgagcgcgagcaaggacagacccgtctgaccctgtattgcatctgcaaccaccccggcctgcatgaaagtctttgttgtctgctgtgtactgagtataataaaagctgagatcagcgactactctggactcgattgtggtgttcctgctatcaaccggtccctgttcttcaccggaaacgagaccgagctccagctccagtgtaagccccacaagaagtacctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcggcgctccccgctactaacaaccaaactacccaccaacgccaccgtcgcgacctttcctctgaatctaataccacccacaccggaggtgagctccgaggtcgaccaacctctgggatttactacggcccctgggaggtggtggggttaatagcgctaggcctagttgcgggtgggcttttggttctctgctacctatacctcccttgctgttcgtacttagtggtgctgtgttgctggtttaagaaatggggaagatcaccctagtgagctgcggtgcgctggtggcggtggtgctttcgattatgggactgggcggcgcggctgtagtgaaggaggagaaggccgatccctgcttgcatttcaatcccgacaaatgccagctgagttttcaggccgatggcaatcggtgcgcggtgctgatcaagtgcggatgggaatgcgagaacgtgagaatcgagtacaataacaagactcggaacaatactctcgcgtccgtgtggcagcccggggaccccgagtggtacaccgtctctgtccccggtgctgacggctccccgcgcaccgtgaataatactttcatttttgcacacatgtgcgacacggtcatgtggatgagcaagcagtacgatatgtggccccccacgaaggagaacatcgtggtcttctccatcgcttacagcctgtgcacggtgctaatcaccgctatcgtgtgcctgagcattcacatgctcatcgctattcgccccagaaataatgccgagaaagaaaaacagccataacacgttttttcacacacctttttcagaccatggcctctgttaaatttttgcttttatttgccagtctcattgccgtcattcatggaatgagtaatgagaaaattactatttacactggcactaatcacacattgaaaggtccagaaaaagccacagaagtttcatggtattgttattttaatgaatcagatgtatctactgaactctgtggaaacaataacaaaaaaaatgagagcattactctcatcaagtttcaatgtggatctgacttaaccctaattaacatcactagagactatgtaggtatgtattatggaactacagcaggcatttcggacatggaattttatcaagtttctgtgtctgaacccaccacgcctagaatgaccacaaccacaaaaactacacctactaccaccacacagctcactaccaatggctttcttgccatgcttcgagtggctgaaaatagcaccagcattcaacccaccccacccagtgaggaaattcccagatccatgattggcattattgttgctgtagtggtgtgcatgttgatcatcgccttgtgcatggtgtactatgccttctgctacagaaagcacagactgaacgacaagctggaacacttactaagtgttgaattttaattttttagaaccatgaagatcctaggccttttagttttttctatcattacctctgctctatgcaattctgacaatgaggacgttactgtcgttgtcggatcaaattatacactgaaaggtccagcgaagggtatgctttcgtggtattgctattttggatctgacactacagaaactgaattatgcaatcttaagaatggcaaaattcaaaattctaaaattaacaattatatatgcaatggtactgatctgatactcctcaatgtcacgaaagcatattctggcagctacacctgccctggagatgatgctgacaatatgattttttacaaagtggaagtggttgatcccactactccacctccacccaccaccacaaccactcataccacacacacagaacaaaccacagcagaggaggtagcaaagttagccttgcaggtccaaggcagttcatttgttggcattacccctacacccgatcagcggtgtccggggctgctcgtcagcggcattgtcggtgtgctttcgggattagcagtcataatcatctgcatgttcatttttgcttgctgctatagaaggctttaccgacaaaaatcagacccactgctgaacctctatgtttaattttttccagagccatgaaggcagttagcactctagttttttgttctttgattggcactgtttttagtgttagctttttgaaacaaattaatgttactgagggggaaaatgtgacactggtaggcgtagaaggtgctcaaaataccacctggacaaaataccacctcgatgggtggaaagatatttgcaattggagtgtcattacttacacatgtgagggagttaatttgaccatagtcaatgccagccaaaatcagaagggttggattaaagggcaatctgttagtgttaccagtgaggggtactatacccagcatactcttatctatgacattatagtcataccgctgcctacgcctagcccacctagcactaccacacagacaacccacactacacacacaaccacatacagtacatcaaatcagcctaccaccactacagcagcagaggttgccagctcgtctggagtccaagtggcatttttgttgttgcccccatctagcagtcccactgctagtaccaatgagcagactactgaatttttgtccactgtcgagagccacaccgcagctacctccagtgccttctctagcaccgccaatctctcctcgctttcctctacaccaatcagtcccgctactactactcctacccccgctcttctccccactcccctgaagcaaactgaggacggcggcatgcaatggcagatcaccctgctcattgtgatcgggttggtcatcctggccgtgttgctctactacatcttctgccgccgcattcccaacgcgcaccgcaagccggtctacaagcccatcgttgtcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcatcacctgcatctgctgctgtagcatagtctgcctgcttatcaccttcttccagttcattgactggatctttgtgcgcatcgcctacctgcgccaccacccccagtaccgcgaccagcgagtggcgcggctgctcaggatcctctgataagcatgcgggctctgctacttctcgcgcttctgctgttagtgctcccccgtcccgtcgacccccggacccccacccagtcccccgaggaggtccgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcaacctcaggcacacgcactaccaccaccaccacagcctaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcaccc

SEQ ID NO: 268 - protein, 190 aa, Artificial Sequence; identical to SEQ ID NO: 109
  Synthetic Construct

SEQ ID NO: 269 - protein, 208 aa, Artificial Sequence; identical to SEQ ID NO: 110
  Synthetic Construct

SEQ ID NO: 270 - protein, 293 aa, Artificial Sequence; identical to SEQ ID NO: 104
  Synthetic Construct

SEQ ID NO: 271 - protein, 135 aa, Artificial Sequence; identical to SEQ ID NO: 54
  Synthetic Construct

SEQ ID NO: 272 - DNA, 38671 bp, Artificial Sequence
  Simian adenovirus A1316 clone
  misc_feature (5)..(12): Pme\I
  repeat_region (16)..(143): ITR
  misc_feature (448)..(473): I-Ceu recognition site
  misc_feature (461)..(462): cleavage point for bottom strand
  misc_feature (465)..(466): cleavage point for top strand
  enhancer (815)..(1075): Enhancer
  misc_feature (1076)..(1303): CMV\promoter
  TATA_signal (1277)..(1280): TATA
  CDS (1399)..(2490): Gag\short
  polyA_signal (2643)..(2845): BGH-PolyA
  misc_feature (2918)..(2956): PI-Scel recognition sequence
  misc_feature (2928)..(2929): cleavage point on bottom strand
  misc_feature (2932)..(2933): cleavage point on top strand
  CDS (3434)..(3859): pIX
  misc_feature (3924)..(5545): IVa2    complement (3924..5254,5533..5545)
  misc_feature (5027)..(13779): pol    complement (5027..8608,13771..13779)
  misc_feature (8410)..(13779): pTP   complement (8410..10338,13771..13779)
  CDS (10771)..(11949): 52K
  CDS (11976)..(13742): pIIIa
  CDS (13827)..(15416): penton
  CDS (15420)..(15998): pVII
  CDS (16043)..(17074): V
  CDS (17098)..(17328): pX
  CDS (17363)..(18136): pVI
  CDS (18224)..(21055): hexon
  CDS (21082)..(21714): protease
  misc_feature (21794)..(23329): DBP    complement (21794..23329)
  CDS (23358)..(25760): 100K
  CDS (26382)..(27062): pVIII
  misc_feature (26957)..(26957): n is a, c, g, or t
  CDS (27340)..(27972): E3\CR1-alpha
  CDS (28462)..(29253): E3\CR1-beta
  CDS (29269)..(29892): E3\CR1-gamma
  CDS (29915)..(30811): E3\CR1-delta
  CDS (30823)..(31095): E3\RID-alpha
  CDS (31104)..(31532): E3\RID-beta
  CDS (32183)..(33508): fiber
  misc_feature (33601)..(34748): E4\orf6/7    complement (33601..33852,34575..34748)
  misc_feature (33852)..(34748): E4\orf6    complement (33852..34748)
  misc_feature (34841)..(35182): E4\orf4    complement (34841..35182)
  misc_feature (35031)..(35381): E4\orf3    complement (35031..35381)
  misc_feature (35381)..(35767): E4\orf2    complement (35381..35767)
  repeat_region (36470)..(36597): ITR   complement (36470..36597)
  misc_feature (36601)..(36608): Pme\I
  rep_origin (36847)..(36847): ORI
  misc_feature (37605)..(38468): AP(R)    complement (37605..38468)
aattgtttaaactaccatcatcaataatatacctcaaactttttgtgcgcgttaatatgcaaatgaggcgtttgaatttggggatgcggggttgtgattggctgcggggaaggcgaccgttaggggcggggcgggtgacgtttcgatgacgtggccgtgaggcggagccggtttgcaagttctcgtgggaaaagtgacgtcaaacgaggtgtggtttgaacacggaaatactcaattttcccagcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacgtaactataacggtcctaaggtagcgaaagctcagatctggatctcccgatcccctatggcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacagagagatgggtgcgagagcgtcagtattaagcgggggagaattagatcgatgggaaaaaattcggttaaggccagggggaaagaagaagtacaagctaaagcacatcgtatgggcaagcagggagctagaacgattcgcagttaatcctggcctgttagaaacatcagaaggctgtagacaaatactgggacagctacaaccatcccttcagacaggatcagaggagcttcgatcactatacaacacagtagcaaccctctattgtgtgcaccagcggatcgagatcaaggacaccaaggaagctttagacaagatagaggaagagcaaaacaagtccaagaagaaggcccagcaggcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaggacctgaacacgatgttgaacaccgtggggggacatcaagcagccatgcaaatgttaaaagagaccatcaatgaggaagctgcagattgggatagagtgcatccagtgcatgcagggcctattgcaccaggccagatgagagaaccaaggggaagtgacatagcaggaactactagtacccttcaggaacaaataggatggatgacaaataatccacctatcccagtaggagagatctacaagaggtggataatcctgggattgaacaagatcgtgaggatgtatagccctaccagcattctggacataagacaaggaccaaaggaaccctttagagactatgtagaccggttctataaaactctaagagctgagcaagcttcacaggaggtaaaaaattggatgacagaaaccttgttggtccaaaatgcgaacccagattgtaagaccatcctgaaggctctcggcccagcggctacactagaagaaatgatgacagcatgtcagggagtaggaggacccggccataaggcaagagttttgtagggatccactagttctagactcgagggggggcccggtacctttaagaccaatgacttacaaggcagctgtagatcttagccactttttaaaagaaaaggggggactggaagggctaattcactcccaaagaagacaagataaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcacatatgctagccaccgtgcatgtggcctcccatgctcgcaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaagtgtggaagattctgagatatgatgaatccaagaccaggtgccgagcctgcgagtgcggagggaagcatgccaggttccagcccgtgtgtgtggatgtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagcatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctactacggcactctggtggccaactcgagttccaccaataatcccgccagcctgaacgaggagaagctgctgctgctgatggcacagctcgaggccttgacccagcgcctgggcgagctgacccagcaggtggctcagctgcaggagcagacgcgggctgcggttgccacggtgaaatccaaataaaaaatgattcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgntgcacnatntcnttgaggaggagactgatggccacgggcagcccnttggtgtaggtgttnacnaanctnttnagctgggagggatgcatgcggggggagatgagntgcatcttggcctggatcttgagattggcgatgttnccgcccagatcccgccnggggttcatgttgtgcaggaccaccagcacggtgtatccggtgcacttggggaatttntcatgcaacttggaagggaaggcgtgaaagaatttggngacgcccttgtgnccgcccaggttttccatgcactcatccatgatgatggcgatgggcccgtgggcggcggcctgggcaaagacgtttcgggggtcggacacatcntagttgtggtcctgggtgagntcntcataggccattttaatgaatttggggcggagggtgcccgantgggggacnaaggtnccctcgatcccgggggcgtagttnccctcncagatctgcatctcccaggcnttgagctcggagggggggatcatgtccacctgcggggcgatnaanaanacggtttccggggcgggggagatgagctgggccgaaagcangttncggagcagctgngacttgccgcagccggtggggccgtagatgaccccgatgaccggctgcaggtggtagttgagggagagacagctgccgtcctcncggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcttcgagcggtgtgccgcggtcctcctcgtagaggaaccccgcccactccgagacgaaagcccgggtccaggccaagacaaaggaggccacgtgggacgggtagcggtcgttgtccaccagcgggtccaccttctccagggtatgcaaacacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggccgcgatgttgagctgcacgtactcgcgcgccacgcacttccattcggggaagacggtggtcagctcgtcgggcacgattctgacctgccagccccgattatgcagggtgatgaggtccacgctggtggccacctcgccgcgcaggggctcgttggtccagcagaggcgcccgcccttgcgcgagcagaaggggggcagggggtccagcatgacctcgtcgggggggtcggcatcgatggtgaagatgccgggcaggagatcggggtcgaagtagctgatggaagtgcccagatcgtccagggaagcttgccattcgcgcacagccagcgcgcgctcgtagggactgaggggcgtgccccagggcatggggtgggtgagcgcggaggcgtacatgccgcagatgtcgtagacgtagaggggctcctcgaggatgccgatgtaggtggggtagcagcgccccccgcggatactggcgcgcacgtagttatacagctcgtgcgagggcgcgaggagaccggggcccaggttggtgcgactgggcttttcggcgcggtagacgatctggcggaagatggcatgcgagttggaggagatggtgggcctttggaagatattgaagtgggcgtgggggaggccgaccgagtcgcggatgaagtgggcgtaggagtcttgcagcttggcgacgagctcggcggtgacgaggacgtccagagcgcagtagtcgagggtctcctggatgatgtcatacttgagctggcccttttgtttccacagctcgcggttgagaaggaactcttcgcggtccttccagtactcttcgagggggaacccgtcctgatctgcacggtaagagcctagcatgtagaactggttgacggctttgtaggcgcagcagcccttctccacggggagggcgtaggcctgggcggccttgcgcagggaggtgtgcgtgagggcgaaagtgtccctgaccatgactttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttgatgttgtggcccacgatgtaaagttccacgaaccgtgggcggcccttgacgtggggcagcttcttgagttcctcgtaggtgagctcgtcggggtcgctgaggccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcggtcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgaaccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccacgcgggaggcaggtccagacctcggcgcgagcgggtcggagagcgaggacgagagcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccatgcccctggggtgtgaccaccgtcccccgtttcttcttgggcggctggggcgacgggggcggtgcttcggcttccatggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcttggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcgacggagcggcatctcgctgacgtcgcccagcgcctccaaacgttccatggcctcgtaaaagtccacggcgaagttgaaaaactgggagttgcgcgccgagacggtcaactcctcctccagaagacggataagctcggcgatggtggcgcgcacctcgcgctcgaaggcccccgggagttcctcctcttcctcttcttcctcctcctccactaacatctcttctacttcctcctcaggcggcagtggtggcgggggagggggcctgcgtcgccggcggcgcacgggcagacggtcgatgaaacgctcgatggtctcgccgcgccggcgtcgcatggtctcggtgacggcgcgcccgtcctcgcggggcctcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggccggaaatgagactagtaagcgcggaaagcgaccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgtttttttgtttttgccagatgcatcccgtactgcggcagatgcgcccccaccaccctccaccgcaacaacagccccctcctccacagccggcgcttctgcccccgccccagcagcagcaacttccagccacgaccgccgcggccgccgtgagcggggctggacagagttatgaccaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctaagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggccggtcccccctacgtagaagaggtggacgatgaggtggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcgcccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcgccgaggaggagcgcatcctgcgatacgtgcagcagagcgtgggcctgttcctgatgcaggagggggccactcccagcgccgcgctcgacatgaccgcgcgtaacatggagcccagcatgtacgccagcaaccgcccgttcatcaataagctgatggactacttgcatcgggcggccgccatgaactctgactatttcaccaacgccattctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgcccgtcctcggcgctgtccgggcgcgagggtgctgccgcggcggtgcccgaggccgccagtcctttcccgagcttgcccttctcgctgaacagtatccgcagcagcgagctgggcaggatcacgcgcccgcgcttgctgggcgaggaggagtacttgaatgactccttgctgagacccgagcgggagaagaacttccccaataacgggatagagagcctggtggacaagatgagccgctggaagacgtatgcgcaggagcacagggacgatccgtcgcagggggccgcgagccggggcagcgccgcccgtaaacgccggtggcacgacaggcagcggggactgatgtgggacgatgaggattccgccgacgacagcagcgtgttggacttgggtgggagtggtaacccgttcgctcacctgcgcccccgcatcgggcgcatgatgtaagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgccaaacgtgaacgagttcatgtacagcaacaagttcaaggcgcgggtgatggtctcccgcaagacccccaacggggtgacagtgacagatggtagtcaggatatcttggagtatgagtgggtggagtttgagctgcccgaaggcaacttctcggtgaccatgaccatcgacctgatgaacaacgccatcatcgacaattacttggcggtggggcggcagaacggggtcctggaaagcgacatcggcgtgaagttcgacactaggaacttcaggctgggctgggaccccgtgaccgagctggtcatgcccggggtgtacaccaacgaggccttccatcccgatattgtcttgctgcccggctgcggggtggacttcaccgagagccgcctcagcaacctgctgggcattcgcaagaggcagcctttccaggagggtttccagatcatgtacgaggatctggaggggggcaacatccccgcgctcctggatgtcgaggcctatgagaaaagcaaggaggagagcgctgccgcggcgaccacagccgtagccaccgcctctaccgaggtcaggggcgataattttgccagccctgcagcagtggcagcggccgaggcggctgaaaccgaaagtaagatagtcattcagccggtggagaaggatagcaaggacaggagctacaacgtgctgccggacaagataaacaccgcctaccgcagctggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgacaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaagcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgatgtggacgatatggtggagtttgtgcgcgagttcgcccccaggcggcgcgtgcagtggcgcgggcggaaggtgcgaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgctccgcgccgaaggaagaagcggtgtccatcccgctggaccacggcaaccccacgccgagcctcaagcccgtgaccctgcagcaggtgctgccgaccgcggcgccgcgaagggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagatccccacggagcccatggaaacgcagaccgagcccatgatcaagcccagcaccagcaccatggaggtgcagacggatccctggatgccagccgcccccaccagcgggcgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccacccgccgccaccgtcgccgcacaaccgctgcaactaccgccgccgccctggtgcggagagtgtaccgccgcggccgcgcgcctctgaccctgccgcgcgcgcgctaccacccgagcatcgccatttaaaactttcgcctgctttgcagatggccctcacatgccgcctccgcgtccccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcaacaaggcgtggaacagcaccacagggcaggcgctgagggaaaagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtgaaactgggtctgcccaccacgcggcccatcgcgcccctggccaccggggtgctgaaacccgagagtagtaagcccgcgaccctggacttgcctcctcccgcttcccgcccctccacagtggctaagcccctgccgccggtggccgtggcccgcgcgcgacccgggggctccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgctgtcgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacgccctggcccctaaagccgctcctaatcctagccagtgggaggaaaccactactggaacggatggaaatgctgctactacaactacacatagttttggcctggctgctatgaaaggggacaatattacatctgacggtttgcaaataggaacagatgctacttctggagaggaaaaacccatctatgcagataaactgtaccagccagaaccccaaataggggaagagtcatggactgatactgatggaaccaatgaaaaattcggaggaagagtccttaaaaaggacacaagcatgaaaccctgctacgggtcatttgccaaaccaaccaataacaaaggtggtcaagcaaaacaaaaggcaactgaaggaaccgctgtagaatatgatgtagacatgaacttttttgatggtagagatgcagctgctaactttactccagaagtagtgttgtatgctgaaaatgtggatttggaaactccagatacacatattgtatacaaaccaggaacctcagatgtgagttcccatgttaatttgggacagcaagccatgcccaacagacccaactacattggtttcagagacaactttattggtctcatgtattacaacagcactggcaatatgggggtgctggccggtcaggcttctcagctgaatgctgtggttgacttgcaagacagaaacactgaactgtcctaccagctgttgcttgactctttgggtgacagaactcggtatttcagtatgtggaatcaggcggtggacagctatgatcctgatgtgcgcatcattgaaaatcatggtatagaagatgagcttcccaactattgctttcctattgacgctgtgggtattactagaacttatcaaggtatcaaaacgcaaaatggtcaaactacaacttgggaaaaggacaccagtgttagtacggccaatgaaataggcattggcaacaatcttgccatggaaatcaacatccaagccaacctgtggaggaacttcctctacgccaacgtggccctgtacctgcccgattcttacaagtacacaccggccaacgtcaccctgcccaccaataccaacacctacgattacatgaacggccgggtggtggcgccctcgctggtggacgcctacatcaacatcggggcgcgctggtcgctggaccccatggataacgtgaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagctgctatggcctgtgggtcctcgcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgtcgcagcgccctggccaccgaggaccgctgcatcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaaaccgtgtgtgtatgttaaaatatcttttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcattggccatcccgaagggggtcatcttgcaggtctgccttcccatggtgggcacgcagccgggcttgtggttgcaatcgcagtgcagggggatcagcatcatctgggcctggtcggcgttcattcccgggtacatggccttcatgaaagcctccaattgcctaaaagcttgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggttccgtgcaggcaccgcagcttgccctcggcctcggtgcatccgtgcagccacagcgcgcacccggtgcactcccagttcttgtgggcgatctgggaatgcgcgtgcacgaacccctgcaggaagcggcccatcatggtcgtcagagtcttgttgctagtgaaggtcagcgggatgccgcggtgctcctcattgatgtacaggtggcagatgcggcggtacacctcgccctgctcgggcatcagctggaaattggctttcaggtcggtctccacgcggtagcggtccatcagcatagtcatgatttccatgcccttctcccaggccgagacgatgggcaggctcatagggttcttcaccatcatcttagcactagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacatcctgcaggaccacatgcttggtcttgcggggtttcttcttgggcggcagcggtggtggagatgcttgtggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccaccgccgacgagaagcagcagcagcagaatgaaagcttaaccgctccgccgcccagccccgccacctccgacgcggcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatgacggcgactacctccacctgagcggaggggtggacgcgctcatcaagcatctggcccgacaggccatcatcgtcaaggacgcgctgctcgaccgcaccgaggtgcccctcagcgtggaggagctcagccgcgcctacgagctcaacctcttctcgccgcgtgtgccccccaagcgccagcccaacggcacctgcgagcccaacccgcgcctcaacttctacccggttttcgcggtgcccgaggccctggccacctaccacatcttttttaagaaccaaaagatccccgtctcctgccgcgccaaccgcacccgcgccgacgcccttttcaacctgggccccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctacccctcagagtttggaagagcggcgcaagctcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgattgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttcagccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggtttcccccaggatgccccgaggaaacaagaagctgaaagtggagctgccgcccgtggaggatttggaggaagactgggagagcagcagtcaggcagaggagatggaggaagactgggacagcactcaggcagaggaggacagcctgcaagacagtctggaagacgaggaggtggcagaggaggaggtggaagaagcagccgccgccagaccgtcgtcctcggcggaggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaacttcccccgcaacatcttgcattactaccgtcacctccacagcccctactacttccaagaagaggcagcagcagaaaaagaccatcagcagaaaaccagctagaaaatccacagcggcaggtggactgaggatcgcggcgaacgagccggcgcagactcgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttnactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcgtatcttcagccagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccggtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccggcacctatcagtgcatctcgggaccctgccatcacaccttccacctgatcccgaataccacctcttccccagcgccgctccccactaacaaccaaactaaccaccaacgctaccgacgcgacctcgtttctgaatctaataccacccacaccggaggtgagctccgaggtcctgattcctctgggatttattacggcccctgggaggtggtggggttaatagctttaggcttagtggcgggtgggcttttggctctctgctacctatacctcccttgcttttcctacttagtggtgctttgttgctggtttaaaaaatggggaagatcaccctagtgtgcggtgtgctggtgacggtggtgctttcgattctgggagggggaagcgcggctgtagtgacggagaagaaggccgatccctgcttgactttcaaccccgataaatgccagctgagttttcagcccgaaggcaatcggtgcatagtgctgatcaagtgcggatgggaatgcaaggatgtgagaatccagcacaataacaagacgcggaacaatactctcgcgtccacatggcagcccggggaccccgagtggtacaccgtctctgtccctggtgctgacggctccctccgcacggtgaacaacactttcatttttgagcacatgtgcgaaaccgccatgttcatgagcaagcagtacggcatgtggcctccgcgtaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacattcacacaccttgttttttacagacaatgcgtctgttaatttttgttatcattacactcagcattaataatgcccatggctatgcaaatatacaaaaaaccctctatgtaggctctgactctacattagaaggtactcaatctcaagccagggtttcatggtatttttataaaggcaatgataaaccaattactctttgcaaaggtgatcaggggcgcataacaaagccacctatcacatttagctgcaccagaacaaacctcacgcttttatccattacaaaacaatatgctggcacttattacagcacaaattttcatagtgggcaagataaatattatactgttaaggtagaaaaccctactacccctagaacaactacaaagcccaccacaactaagaagcccactacacctaagaagcctaccacgcccaaaaccactaagacaacaactactaagaccactaccacagagccaaccacgaccagcaccacacttgctataactacacacacacacactgagctgacctcgcaggcaactactgaaaatggttttgccctactgcagaagggggagaacagtagcagcagtcttatgcctactacccccagtgaggaaatacccaagtccatggttggcattatcgctgctgtagtggtgtgtatggtgattatcatcttgtgcatgatgtactatgcctgctactacagaaaacacaggctgaacaacaagctggaccccctactgaatgttgatttttaattttttagaaccatgaagatcctaagcctttttgttttttctataattattacctctgctatttgtgaatcagtggataaggacgttactgtcaccactggctctaattatacactaaaagggccttcctcaggtatgctttcgtggtattgttattttggaaatgatgataaacagacagagctatgtaattttcagaacggcaaaaccaaaaattctaaaatagataactatcaatgccagggtactgatttagtactgatgaatatcacgaaagcatatgctggcagttattcatgtcctggacaaaacaccgaggaaatgattttttacaaattaattgtagttgaccctactactccagcaccaaccaccacaactaccaaggcacataccacagacacacaggaaaccactccagaggcagaagcagagatagcaaagcagattcatgaagattcctttgttgccaatacccccacacaccccggaccgcaatgtccagggccattagtcagcggcattgtcggtgtgctttgcgggttagcagttataatcatctgcatgttcatttttgcttgctgctacagaaggcttcaccgacaaaaatcagacccactgctgaacctctatgtttaatttttgattttccagagccatgaaggcacttagcactttagtatttttgtccttgattggcattgtttttactagtcaaattaccagggttagatttatcaaatatgttaatgttactgaaggagataatatcacactagcaggtgtagaaggtgcccaaaacaccacctggacaaaataccatctcgggtggaaagatatttgcacctggaatgtcacttatttttgcataggagttaatcttaccattgtcaatgctaatcaatctcagaatggattaattaaaggccaaagtgttagtgtgaccagtgatgggtattatacccagcatagtttcaactacaacatcactgtcataccactgcccacacctagtccacctagcactactcaaaccacacaaacaactcacactacacagaactccacaactaccatgcagaccactcagacaactacatcccctcagcccaccaccactacagcagaggcgagtagctcacctaaaattgaagtggcatttttgttactgccaccatctagcagtcccactgctagtaccaatgagcagactactgaatttttgtccactactcagagcagcaccacagctacctcgagtgccttctctagcaccgccaatctcacctcgctttcctctacgccaatcagtaacgctactacctcccccgctcctcttcccactcctctgaagcaatccgagtctagcacgcagctgcagatcaccctgctcattgtgatcggggtggtcatcctggcagtgctgctctactttatcttctgccgccgcatccccaacgcgaaaccggcctacaagcccattgttatcgggacgccggagccgcttcaggtggagggaggtctaaggaatcttctcttctcttttacagtatggtgatttgaactatgattcctagacatttcattatcacttctctaatctgtgtgctccaagtctgtgccaccctcgctctcgtggctaacgcgagtccagactgcattggagcgttcgcctcctacgtgctctttgccttcatcacctgcatctgctgctgtagcatagtctgcctgcttatcaccttcttccagttcgttgactgggtctttgtgcgcatcgcctacctgcgccaccatccccagtaccgcgaccagagagtggcgcaactgttgaggctcatctgataagcatgcgggctctgctactcctcgcgcttgcactagctcccctcgccgcccccttaaccttcaaatcccccacccagtcccccgaagaggttcgaaaatgtaaattccaagaaccctggaaattcctcaaatgctaccagctcaaatcagaaatgcaccccagctggatcatgatcattggaatcgtgaacatccttgcctgtactctcatctcctttgtgatttacccctgctttaactttgggtggaacgcacccgaggcgctctggctcccgcctgatcccgacacaccaccacagcagcagcaaaatcaggcacacgcaccaccacagcctaggccacaatacatgcccatcttagactatgaggccgagccacagcgagccatgcttcctgctattagttacttcaatctaaccggcggagatgactgaccccatggccaacaacaccgtcaacgacctcctggacatggacggccgcggctcggagcagcgactcgcccaactccgcatccgccagcagcaggagagagccgtcaaagagctgcaggatgcggtggccatccaccagtgcaagaaaggcatcttctgcctggtgaagcaggccaagatcaccttcgaggtgacttccaccgaccatcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaacccctaccccctttaccctcaagtaaaaataaagattaaaaaatgattgaattgatcaataaagaatcacttacttgaaatctgaaaccaggtctctgtccatgttttctgtcagcagcacttcactcccctcttcccagctctggtactgcaggccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtctctgcgcctggccgaccccgtcaccaccaagaacggggctgtcaccctcaagctgggggagggggtggacctcgacgactcgggaaaactcatctccaaaaatgctaccaaggccactgcccctctcagtatttccaacggcaccatttcccttaacatggatacccctttttacaccagcgatggaaaattatccttacaagtttatccaccattaaacatattaagaacacccattatcaacacattagctttagcatataagtcaggtttaggtgtaagtgacaaatcccttgctgttcaattagcttctccactcatttttgatgaaaaaggaaacatagaaattaacttgggaagtgggccattaacagttgcatcaaatcaacttagcattaactgtcaaagaggtgtacatatcactaccgcaggagatgcacttgaaacaaacataagttgggctaaaggcataagatttgaaagtgatgccatagctgcaaacattggcaaaggattagaatttggaaccactagtacagagtccgatgtcacagatgcatttccaattcaagttaaattgggcactggccttacatttgacagcacaggagctattgttgcttggaacaaagaggatgacaagcttacactatggaccacagctgacccatctccaaactgtcacatatattctcaaaaagatgctaagcttactctttgtttgacaaagtgcggcagtcagatactgggcactgtttccctcatagctgttaatactggcagcttaaatccaataacaggaacagtacatactgctcttgtttcacttaaattcgatgcaagtggggttttgcaaaccagttcaacattggataaagaatattggaatttcagaaaaggagatgtaacacctgcagatccctacactaatgctataggttttatgcccaaccttaatgcatatccaaaaaacacaagtgcagctgcaaaaagtcacattgttggaaaagtatacctaaatggtgatgtagcaaagccactggacttgataattacatttaatgaaaccagcgatgaaacctgtacctattgcattaactttcagtggcagtggggagctgatgaatataaaaatgaaacgcttgctgtcagttcattcaccttctcctacattgctaaagaataaaccctgcatgccaacccctttcccacaactatggaaaactctgaagcagaaaaaataaagttcaagtgttttattgattcaacagtttttcacagaattcgagtagttattttccctcctccctcccaactcatggaatacaccaccctctccccacgcacagccttaaacatctgaatgccattggtaatggacatggttttggtctccacattccacacagtttcagagcgagccagtctcgggtcggtcagggagatgaaaccctccgggcactcctgcatctgcacctcaaagttcagtagctgagggctgtcctcggtggtcgggatcacagttatctggaagaagagcgatgagagtcataatccgcgaacgggatcgggcggttgtgccgcatcaggccccgcagcagtcgctgtctgcgccgctccgtcaagctgctgctcaaggggtccgggtccagggactccctgcgcatgatgccgatggccctgagcatcagtcgcctggtgcggcgggcgcagcagcgaatgcggatctcactcaggtcggagcagtacgtgcagcacagcaccaccaagttgttcaacagtccatagttcaacgtgctccaaccaaaactcatctgtggaactatgctgcccacatgtccatcgtaccagatcctgatgtaaatcaggtggcgccccctcaagaacacactgcccatgtacatgatctccttgggcatgtgcaggttcaccacctcccggtaccacatcacccgctggttgaacatgcagccctggataatcctgcggaaccagatggccagcaccgccccgcccgccatgcagcgcagggaccccgggtcctggcagtggcagtgaaggacccaccgctcacggccgtggatcaactgggagctgaacaagtctatgttggcacagcacaggcacacgctcatgcatgtcttcagcactctcagttcctcgggggtcaggaccatgtcccagggcacggggaactcttgcaggacagtgaacccggcagaacagggcaaccctcgcacacaacttacattgtgcatggacagggtatcgcaatcaggcagcaccggatgatcctccaccagagaagcgcgggtctcggtctcctcacagcgaggtaagggggccggtggttggtacggatgatggcgggatgacgctaatcgtgttctggatcgtgtcatgatggagctgtttcctgacattttcgtacttcacgaagcagaacctggtccgggcactgcacaccgctcgtcggcgacggtctcggcgcttcgagcgctcggtgttgaagttatagaacagccactccctcagagcgtgcagtatctcctgagcctcttgggtgatgaaaatcccatccgccctgatggctctgatcacatcgaccacggtggaatgggccagacccagccagatgatgcaattttgttgggtttcggtaacggcgggggagggaagaacaggaagaaccatgattaactttattccaaacggtctcggagcacttcaaaatgcaggtcccggagatggcacctctcgcccccactgtgttggtggaaaataacagccaggtcaaaggtgacacggttctcgagatgttccacggtggcttccagcaaagcctccacgcgcacatccagaaacaagaggacagcgaaagcgggagcgttctctaattcctcaatcatcatattacactcctgcaccatccccagataattttcatttttccagccttgaatgattcgtattagttcctgaggtaaatccaagccagccatgataaaaagctcgcgcagagcgccctccaccggcattcttaagcacaccctcataattgcaagagatcctgttcctggttcacctgcagcagattaacaatgggaatatcaaaatctctgccgcgatccctgagctcctccctcaacaataactgtatgtaatctttcatatcctctccgaaatttttagccataggaccgccaggaataagagaaggagaagccacagtacagataaagcgaagtcctccccagtgagcattgccaaatgtaagattgaaataagcatgctggttagacccggtgatatcttccagattactggacagaaaatcgggcaagcaatctttcagaaactgaacaaaagaaaagtcctctaggtgcacgtttagagcctcgggaacaacgatggaataagtgactgggctgcgctccagcatggttagtgttttttggtgatctgtagaataaaaaataaaacatgcaatattaaaccatgctagcctggcgaacaggtgggtaaatcactctttccagcaccaggcaggctacagggtctccggcgcgaccctcgtagaaactgtcgccatgattgaaaagcatcaccgagagaccttcccggtggccggcatggatgattcgagaagaagcatacactccgggaacattggcgtccgtgagtgaaaaaaagcgacctataaagcctcgaggcactacaatgctcaatcttaattccagcaaagccaccccatgcggatgaagcacaaaattggcaggtgcgtaaaaaatgtaattactcccctcctgcacaggcagcaaagcccccgctccctccagaaacacatacaaagcctcagcgtccatagcttaccgagcacggcaggcgcaagagtcagagaaaaggctgagctctaacctgactgcccgctcctgtgctcaatatatagccctaacctacactgacgtaaaggccaaagtctaaaaatacccgccaaaatgacacacacgcccagcacacgcccagaaaccggtgacacactcaaaaaaatacgtgcgcttcctcaaacgcccaaaccggcgtcatttccgggttcccacgctacgtcacctctcagcgactttcaaattccgtcgaccgttaaaaacgtcactcgccccgcccctaacggtcgccttccccgcagccaatcacaaccccgcatccccaaattcaaacgcctcatttgcatattaacgcgcacaaaaagtttgaggtatattattgatgatgatcgtttaaactatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaag

SEQ ID NO: 273 - protein, 363 aa, Artificial Sequence; identical to SEQ ID NO: 169
  Synthetic Construct

SEQ ID NO: 274 - protein, 142 aa, Artificial Sequence; identical to SEQ ID NO: 3
  Synthetic Construct

SEQ ID NO: 275 - protein, 393 aa, Artificial Sequence; identical to SEQ ID NO: 117
  Synthetic Construct

SEQ ID NO: 276 - protein, 589 aa, Artificial Sequence; identical to SEQ ID NO: 118
  Synthetic Construct

SEQ ID NO: 277 - protein, 530 aa, Artificial Sequence; identical to SEQ ID NO: 119
  Synthetic Construct

SEQ ID NO: 278 - protein, 193 aa, Artificial Sequence; identical to SEQ ID NO: 120
  Synthetic Construct

SEQ ID NO: 279 - protein, 344 aa, Artificial Sequence; identical to SEQ ID NO: 121
  Synthetic Construct

SEQ ID NO: 280 - protein, 77 aa, Artificial Sequence; identical to SEQ ID NO: 65
  Synthetic Construct

SEQ ID NO: 281 - protein, 258 aa, Artificial Sequence; identical to SEQ ID NO: 123
  Synthetic Construct

SEQ ID NO: 282 - protein, 944 aa, Artificial Sequence
  Synthetic Construct
ASPSCKMATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNALAPKAAPNPSQWEETTTGTDGNAATTTTHSFGLAAMKGDNITSDGLQIGTDATSGEEKPIYADKLYQPEPQIGEESWTDTDGTNEKFGGRVLKKDTSMKPCYGSFAKPTNNKGGQAKQKATEGTAVEYDVDMNFFDGRDAAANFTPEVVLYAENVDLETPDTHIVYKPGTSDVSSHVNLGQQAMPNRPNYIGFRDNFIGLMYYNSTGNMGVLAGQASQLNAVVDLQDRNTELSYQLLLDSLGDRTRYFSMWNQAVDSYDPDVRIIENHGIEDELPNYCFPIDAVGITRTYQGIKTQNGQTTTWEKDTSVSTANEIGIGNNLAMEINIQANLWRNFLYANVALYLPDSYKYTPANVTLPTNTNTYDYMNGRVVAPSLVDAYINIGARWSLDPMDNVNPFNHHRNAGLRYRSMLLGNGRYVPFHIQVPQKFFAIKSLLLLPGSYTYEWNFRKDVNMILQSSLGNDLRTDGASISFTSINLYATFFPMAHNTASTLEAMLRNDTNDQSFNDYLSAANMLYPIPANATNVPISIPSRNWAAFRGWSFTRLKTKETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVTSVTQKKFLCDRVMWRIPFSSNFMSMGALTDLGQNMLYANSAHALDMNFEVDPMDESTLLYVVFEVFDVVRVHQPHRGVIEAVYLRTPFSAGNATT

SEQ ID NO: 283 - protein, 211 aa, Artificial Sequence; identical to SEQ ID NO: 125
  Synthetic Construct

SEQ ID NO: 284 - protein, 801 aa, Artificial Sequence; identical to SEQ ID NO: 126
  Synthetic Construct

SEQ ID NO: 285 - protein, 227 aa, Artificial Sequence
  misc_feature (192)..(192): The 'Xaa' at location 192 stands for Leu, or Phe.
  Synthetic Construct
MSKEIPTPYMWSYQPQMGLAAGAAQDYSTRMNWLSAGPAMISRVNDIRAHRNQILLEQSALTATPRNHLNPRNWPAALVYQEIPQPTTVLLPRDAQAEVQLTNSGVQLAGGATLCRHRPAQGIKRLVIRGRGTQLNDEVVSSSLGLRPDGVFQLAGSGRSSFTPRQAVLTLESSSSQPRSGGIGTLQFVEEXTPSVYFNPFSGSPGHYPDEFIPNFDAISESVDGYD

SEQ ID NO: 286 - protein, 211 aa, Artificial Sequence; identical to SEQ ID NO: 128
  Synthetic Construct

SEQ ID NO: 287 - protein, 264 aa, Artificial Sequence; identical to SEQ ID NO: 129
  Synthetic Construct

SEQ ID NO: 288 - protein, 208 aa, Artificial Sequence; identical to SEQ ID NO: 130
  Synthetic Construct

SEQ ID NO: 289 - protein, 299 aa, Artificial Sequence; identical to SEQ ID NO: 131
  Synthetic Construct

SEQ ID NO: 290 - protein, 91 aa, Artificial Sequence; identical to SEQ ID NO: 17
  Synthetic Construct

SEQ ID NO: 291 - protein, 143 aa, Artificial Sequence; identical to SEQ ID NO: 133
  Synthetic Construct

SEQ ID NO: 292 - protein, 442 aa, Artificial Sequence; identical to SEQ ID NO: 134
  Synthetic Construct

SEQ ID NO: 293 - DNA, 31980 bp, Artificial Sequence
  Simian adenovirus A1316 clone
  misc_feature (4137)..(4137): n is a, c, g, or t
  misc_feature (4143)..(4143): n is a, c, g, or t
  misc_feature (4146)..(4146): n is a, c, g, or t
  misc_feature (4149)..(4149): n is a, c, g, or t
  misc_feature (4182)..(4182): n is a, c, g, or t
  misc_feature (4197)..(4197): n is a, c, g, or t
  misc_feature (4200)..(4200): n is a, c, g, or t
  misc_feature (4203)..(4203): n is a, c, g, or t
  misc_feature (4206)..(4206): n is a, c, g, or t
  misc_feature (4209)..(4209): n is a, c, g, or t
  misc_feature (4242)..(4242): n is a, c, g, or t
  misc_feature (4278)..(4278): n is a, c, g, or t
  misc_feature (4295)..(4295): n is a, c, g, or t
  misc_feature (4353)..(4353): n is a, c, g, or t
  misc_feature (4391)..(4391): n is a, c, g, or t
  misc_feature (4404)..(4404): n is a, c, g, or t
  misc_feature (4497)..(4497): n is a, c, g, or t
  misc_feature (4518)..(4518): n is a, c, g, or t
  misc_feature (4521)..(4521): n is a, c, g, or t
  misc_feature (4563)..(4563): n is a, c, g, or t
  misc_feature (4572)..(4572): n is a, c, g, or t
  misc_feature (4578)..(4578): n is a, c, g, or t
  misc_feature (4602)..(4602): n is a, c, g, or t
  misc_feature (4608)..(4608): n is a, c, g, or t
  misc_feature (4629)..(4629): n is a, c, g, or t
  misc_feature (4671)..(4671): n is a, c, g, or t
  misc_feature (4674)..(4674): n is a, c, g, or t
  misc_feature (4677)..(4677): n is a, c, g, or t
  misc_feature (4718)..(4718): n is a, c, g, or t
  misc_feature (4722)..(4722): n is a, c, g, or t
  misc_feature (4734)..(4734): n is a, c, g, or t
  misc_feature (4818)..(4818): n is a, c, g, or t
  misc_feature (26957)..(26957): n is a, c, g, or t
  CDS (31528)..(31929): E3\14.7K
aattgtttaaactaccatcatcaataatatacctcaaactttttgtgcgcgttaatatgcaaatgaggcgtttgaatttggggatgcggggttgtgattggctgcggggaaggcgaccgttaggggcggggcgggtgacgtttcgatgacgtggccgtgaggcggagccggtttgcaagttctcgtgggaaaagtgacgtcaaacgaggtgtggtttgaacacggaaatactcaattttcccagcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacgtaactataacggtcctaaggtagcgaaagctcagatctggatctcccgatcccctatggcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacagagagatgggtgcgagagcgtcagtattaagcgggggagaattagatcgatgggaaaaaattcggttaaggccagggggaaagaagaagtacaagctaaagcacatcgtatgggcaagcagggagctagaacgattcgcagttaatcctggcctgttagaaacatcagaaggctgtagacaaatactgggacagctacaaccatcccttcagacaggatcagaggagcttcgatcactatacaacacagtagcaaccctctattgtgtgcaccagcggatcgagatcaaggacaccaaggaagctttagacaagatagaggaagagcaaaacaagtccaagaagaaggcccagcaggcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaggacctgaacacgatgttgaacaccgtggggggacatcaagcagccatgcaaatgttaaaagagaccatcaatgaggaagctgcagattgggatagagtgcatccagtgcatgcagggcctattgcaccaggccagatgagagaaccaaggggaagtgacatagcaggaactactagtacccttcaggaacaaataggatggatgacaaataatccacctatcccagtaggagagatctacaagaggtggataatcctgggattgaacaagatcgtgaggatgtatagccctaccagcattctggacataagacaaggaccaaaggaaccctttagagactatgtagaccggttctataaaactctaagagctgagcaagcttcacaggaggtaaaaaattggatgacagaaaccttgttggtccaaaatgcgaacccagattgtaagaccatcctgaaggctctcggcccagcggctacactagaagaaatgatgacagcatgtcagggagtaggaggacccggccataaggcaagagttttgtagggatccactagttctagactcgagggggggcccggtacctttaagaccaatgacttacaaggcagctgtagatcttagccactttttaaaagaaaaggggggactggaagggctaattcactcccaaagaagacaagataaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcacatatgctagccaccgtgcatgtggcctcccatgctcgcaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggaagtgtggaagattctgagatatgatgaatccaagaccaggtgccgagcctgcgagtgcggagggaagcatgccaggttccagcccgtgtgtgtggatgtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagcatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctactacggcactctggtggccaactcgagttccaccaataatcccgccagcctgaacgaggagaagctgctgctgctgatggcacagctcgaggccttgacccagcgcctgggcgagctgacccagcaggtggctcagctgcaggagcagacgcgggctgcggttgccacggtgaaatccaaataaaaaatgattcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgntgcacnatntcnttgaggaggagactgatggccacgggcagcccnttggtgtaggtgttnacnaanctnttnagctgggagggatgcatgcggggggagatgagntgcatcttggcctggatcttgagattggcgatgttnccgcccagatcccgccnggggttcatgttgtgcaggaccaccagcacggtgtatccggtgcacttggggaatttntcatgcaacttggaagggaaggcgtgaaagaatttggngacgcccttgtgnccgcccaggttttccatgcactcatccatgatgatggcgatgggcccgtgggcggcggcctgggcaaagacgtttcgggggtcggacacatcntagttgtggtcctgggtgagntcntcataggccattttaatgaatttggggcggagggtgcccgantgggggacnaaggtnccctcgatcccgggggcgtagttnccctcncagatctgcatctcccaggcnttgagctcggagggggggatcatgtccacctgcggggcgatnaanaanacggtttccggggcgggggagatgagctgggccgaaagcangttncggagcagctgngacttgccgcagccggtggggccgtagatgaccccgatgaccggctgcaggtggtagttgagggagagacagctgccgtcctcncggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacgagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcttcgagcggtgtgccgcggtcctcctcgtagaggaaccccgcccactccgagacgaaagcccgggtccaggccaagacaaaggaggccacgtgggacgggtagcggtcgttgtccaccagcgggtccaccttctccagggtatgcaaacacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccggcggagatgcctttcaagagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggccgcgatgttgagctgcacgtactcgcgcgccacgcacttccattcggggaagacggtggtcagctcgtcgggcacgattctgacctgccagccccgattatgcagggtgatgaggtccacgctggtggccacctcgccgcgcaggggctcgttggtccagcagaggcgcccgcccttgcgcgagcagaaggggggcagggggtccagcatgacctcgtcgggggggtcggcatcgatggtgaagatgccgggcaggagatcggggtcgaagtagctgatggaagtgcccagatcgtccagggaagcttgccattcgcgcacagccagcgcgcgctcgtagggactgaggggcgtgccccagggcatggggtgggtgagcgcggaggcgtacatgccgcagatgtcgtagacgtagaggggctcctcgaggatgccgatgtaggtggggtagcagcgccccccgcggatactggcgcgcacgtagttatacagctcgtgcgagggcgcgaggagaccggggcccaggttggtgcgactgggcttttcggcgcggtagacgatctggcggaagatggcatgcgagttggaggagatggtgggcctttggaagatattgaagtgggcgtgggggaggccgaccgagtcgcggatgaagtgggcgtaggagtcttgcagcttggcgacgagctcggcggtgacgaggacgtccagagcgcagtagtcgagggtctcctggatgatgtcatacttgagctggcccttttgtttccacagctcgcggttgagaaggaactcttcgcggtccttccagtactcttcgagggggaacccgtcctgatctgcacggtaagagcctagcatgtagaactggttgacggctttgtaggcgcagcagcccttctccacggggagggcgtaggcctgggcggccttgcgcagggaggtgtgcgtgagggcgaaagtgtccctgaccatgactttgaggaactggtgcttgaagtcgatatcgtcgcagcccccctgctcccagagctggaagtccgtgcgcttcttgtaggcggggttgggcaaagcgaaagtaacatcgttgaagaggatcttgcccgcgcggggcataaagttgcgagtgatgcggaaaggctggggcacctcggcccggttgttgatgacctgggcggcgagcacgatctcgtcgaagccgttgatgttgtggcccacgatgtaaagttccacgaaccgtgggcggcccttgacgtggggcagcttcttgagttcctcgtaggtgagctcgtcggggtcgctgaggccgtgctgctcgagcgcccagtcggcgagatgggggttggcgcggaggaaggaagtccagagatccacggccagggcggtttgcagacggtcccggtactgacggaactgctgcccgacggccattttttcgggggtgacgcagtagaaggtgcgggggtccccgtgccagcggtcccatttgagctggagggcgagatcgagggcgagctcgacgagccggtcgtccccggagagtttcatgaccagcatgaaggggacgagctgcttgccgaaggaccccatccaggtgtaggtttccacatcgtaggtgaggaagagcctttcggtgcgaggatgcgaaccgatggggaagaactggatctcctgccaccaattggaggaatggctgttgatgtgatggaagtagaaatgccgacggcgcgccgaacactcgtgcttgtgtttatacaagcggccacagtgctcgcaacgctgcacgggatgcacgtgctgcacgagctgtacctgagttcctttgacgaggaatttcagtgggaagtggagtcgtggcgcctgcatctcgtgctgtactacgtcgtggtggtcggcctggccctcttctgcctcgatggtggtcatgctgacgagcccacgcgggaggcaggtccagacctcggcgcgagcgggtcggagagcgaggacgagagcgcgcaggccggagctgtccagggtcctgagacgctgcggagtcaggtcagtgggcagcggcggcgcgcggttgacttgcaggagtttttccagggcgcgcgggaggtccagatggtacttgatctccaccgcgccgttggtggcgacgtcgatggcttgcagggtcccatgcccctggggtgtgaccaccgtcccccgtttcttcttgggcggctggggcgacgggggcggtgcttcggcttccatggttagaagcggcggcgaggacgcgcgccgggcggcagaggcggctcggggcccggaggcaggggcggcaggggcacgtcggcgccgcgcgcgggtaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcttggtaggcgatctcggtcatgaactgctcgatctcctcctcctgaaggtctccgcggccggcgcgctccacggtggccgcgaggtcgttggagatgcggcccatgagctgcgagaaggcgttcatgcccgcctcgttccagacgcggctgtagaccacgacgccctcgggatcgcgggcgcgcatgaccacctgggcgaggttgagctccacgtggcgcgtgaagaccgcgtagttgcagaggcgctggtagaggtagttgagcgtggtggcgatgtgctcggtgacgaagaaatacatgatccagcgacggagcggcatctcgctgacgtcgcccagcgcctccaaacgttccatggcctcgtaaaagtccacggcgaagttgaaaaactgggagttgcgcgccgagacggtcaactcctcctccagaagacggataagctcggcgatggtggcgcgcacctcgcgctcgaaggcccccgggagttcctcctcttcctcttcttcctcctcctccactaacatctcttctacttcctcctcaggcggcagtggtggcgggggagggggcctgcgtcgccggcggcgcacgggcagacggtcgatgaaacgctcgatggtctcgccgcgccggcgtcgcatggtctcggtgacggcgcgcccgtcctcgcggggcctcagcgtgaagacgccgccgcgcatctccaggtggccgggggggtccccgttgggcagggagagggcgctgacgatgcatcttatcaattgccccgtagggactccgcgcaaggacctgagcgtctcgagatccacgggatctgaaaaccgttgaacgaaggcttcgagccagtcgcagtcgcaaggtaggctgagcacggtttcttctggcgggtcatgttggggagcggggcgggcgatgctgctggtgatgaagttgaaataggcggttctgagacggcggatggtggcgaggagcaccaggtctttgggcccggcttgctggatgcgcagacggtcggccatgccccaggcgtggtcctgacacctggccaggtccttgtagtagtcctgcatgagccgctccacgggcacctcctcctcgcccgcgcggccgtgcatgcgcgtgagcccgaagccgcgctggggctggacgagcgccaggtcggcgacgacgcgctcggcgaggatggcctgctggatctgggtgagggtggtctggaagtcgtcaaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcaccaggtactggtagccgatgaggaagtgcggcggcggctggcggtagagcggccatcgctcggtggcgggggcgccgggcgcgaggtcctcgagcatggtgcggtggtagccgtagatgtacctggacatccaggtgatgccggcggcggtggtggaggcgcgcgggaactcgcggacgcggttccagatgttgcgcagcggcaggaagtagttcatggtgggcacggtctggcccgtgaggcgcgcgcagtcgtggatgctctatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgcaccaaccctccaggatacggaggcgggtcgttttgcaacttttttcggaggccggaaatgagactagtaagcgcggaaagcgaccgaccgcgatggctcgctgccgtagtctggagaagaatcgccagggttgcgttgcggtgtgccccggttcgaggccggccggattccgcggctaacgagggcgtggctgccccgtcgtttccaagacccctagccagccgacttctccagttacggagcgagcccctcttttgtttttttgtttttgccagatgcatcccgtactgcggcagatgcgcccccaccaccctccaccgcaacaacagccccctcctccacagccggcgcttctgcccccgccccagcagcagcaacttccagccacgaccgccgcggccgccgtgagcggggctggacagagttatgaccaccagctggccttggaagagggcgaggggctggcgcgcctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctaagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaggcggccggtcccccctacgtagaagaggtggacgatgaggtggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccatggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggctttcaagaacttgcagggcctgtggggcgtgcaggccccggtcggggaccgcgcgacggtgtcgagcctgctgacgccgaactcgcgcctgctgctgctgctggtggcgcccttcacggacagcggcagcatcaaccgcaactcgtacctgggctacctgattaacctgtaccgcgaggccatcggccaggcgcacgtggacgagcagacctaccaggagatcacccacgtgagccgcgccctgggccaggacgacccgggcaacctggaagccaccctgaactttttgctgaccaaccggtcgcagaagatcccgccccagtacgcgctcagcgccgaggaggagcgcatcctgcgatacgtgcagcagagcgtgggcctgttcctgatgcaggagggggccactcccagcgccgcgctcgacatgaccgcgcgtaacatggagcccagcatgtacgccagcaaccgcccgttcatcaataagctgatggactacttgcatcgggcggccgccatgaactctgactatttcaccaacgccattctgaatccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgcccgtcctcggcgctgtccgggcgcgagggtgctgccgcggcggtgcccgaggccgccagtcctttcccgagcttgcccttctcgctgaacagtatccgcagcagcgagctgggcaggatcacgcgcccgcgcttgctgggcgaggaggagtacttgaatgactccttgctgagacccgagcgggagaagaacttccccaataacgggatagagagcctggtggacaagatgagccgctggaagacgtatgcgcaggagcacagggacgatccgtcgcagggggccgcgagccggggcagcgccgcccgtaaacgccggtggcacgacaggcagcggggactgatgtgggacgatgaggattccgccgacgacagcagcgtgttggacttgggtgggagtggtaacccgttcgctcacctgcgcccccgcatcgggcgcatgatgtaagaaaccgaaaataaatgatactcaccaaggccatggcgaccagcgtgcgttcgtttcttctctgttgttgttgtatctagtatgatgaggcgtgcgtacccggagggtcctcctccctcgtacgagagcgtgatgcagcaggcgatggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgccaaacgtgaacgagttcatgtacagcaacaagttcaaggcgcgggtgatggtctcccgcaagacccccaacggggtgacagtgacagatggtagtcaggatatcttggagtatgagtgggtggagtttgagctgcccgaaggcaacttctcggtgaccatgaccatcgacctgatgaacaacgccatcatcgacaattacttggcggtggggcggcagaacggggtcctggaaagcgacatcggcgtgaagttcgacactaggaacttcaggctgggctgggaccccgtgaccgagctggtcatgcccggggtgtacaccaacgaggccttccatcccgatattgtcttgctgcccggctgcggggtggacttcaccgagagccgcctcagcaacctgctgggcattcgcaagaggcagcctttccaggagggtttccagatcatgtacgaggatctggaggggggcaacatccccgcgctcctggatgtcgaggcctatgagaaaagcaaggaggagagcgctgccgcggcgaccacagccgtagccaccgcctctaccgaggtcaggggcgataattttgccagccctgcagcagtggcagcggccgaggcggctgaaaccgaaagtaagatagtcattcagccggtggagaaggatagcaaggacaggagctacaacgtgctgccggacaagataaacaccgcctaccgcagctggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgacaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacccccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaagcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggtggtgaaggaggaaagaaagccccgcaaaatcaagcgggtcaaaaaggacaaaaaggaagaagatgatgtggacgatatggtggagtttgtgcgcgagttcgcccccaggcggcgcgtgcagtggcgcgggcggaaggtgcgaccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgctccgcgccgaaggaagaagcggtgtccatcccgctggaccacggcaaccccacgccgagcctcaagcccgtgaccctgcagcaggtgctgccgaccgcggcgccgcgaagggggttcaagcgcgagggcgaggatctgtaccccaccatgcagctgatggtgcccaagcgccagaagctggaagacgtgctggagaccatgaaggtggacccggacgtgcagcccgaggtcaaggtgcggcccatcaagcaggtggccccgggcctgggcgtgcagaccgtggacatcaagatccccacggagcccatggaaacgcagaccgagcccatgatcaagcccagcaccagcaccatggaggtgcagacggatccctggatgccagccgcccccaccagcgggcgaagaccccggcgcaagtacggcgcggccagcctgctgatgcccaactacgcgctgcatccttccatcatccccacgccgggctaccgcggcacgcgcttctaccgcggtcatacaagccgccgccgcaagaccaccacccgccgccaccgtcgccgcacaaccgctgcaactaccgccgccgccctggtgcggagagtgtaccgccgcggccgcgcgcctctgaccctgccgcgcgcgcgctaccacccgagcatcgccatttaaaactttcgcctgctttgcagatggccctcacatgccgcctccgcgtccccattacgggctaccgaggaagaaaaccgcgccgtagaaggctggcggggaacgggatgcgtcgccaccaccaccggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcaacaaggcgtggaacagcaccacagggcaggcgctgagggaaaagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgagaagcgaccccgccccgacgcggaggagacgctgctgacgcacacggacgagccgcccccgtacgaggaggcggtgaaactgggtctgcccaccacgcggcccatcgcgcccctggccaccggggtgctgaaacccgagagtagtaagcccgcgaccctggacttgcctcctcccgcttcccgcccctccacagtggctaagcccctgccgccggtggccgtggcccgcgcgcgacccgggggctccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgctgtcgccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaacgccctggcccctaaagccgctcctaatcctagccagtgggaggaaaccactactggaacggatggaaatgctgctactacaactacacatagttttggcctggctgctatgaaaggggacaatattacatctgacggtttgcaaataggaacagatgctacttctggagaggaaaaacccatctatgcagataaactgtaccagccagaaccccaaataggggaagagtcatggactgatactgatggaaccaatgaaaaattcggaggaagagtccttaaaaaggacacaagcatgaaaccctgctacgggtcatttgccaaaccaaccaataacaaaggtggtcaagcaaaacaaaaggcaactgaaggaaccgctgtagaatatgatgtagacatgaacttttttgatggtagagatgcagctgctaactttactccagaagtagtgttgtatgctgaaaatgtggatttggaaactccagatacacatattgtatacaaaccaggaacctcagatgtgagttcccatgttaatttgggacagcaagccatgcccaacagacccaactacattggtttcagagacaactttattggtctcatgtattacaacagcactggcaatatgggggtgctggccggtcaggcttctcagctgaatgctgtggttgacttgcaagacagaaacactgaactgtcctaccagctgttgcttgactctttgggtgacagaactcggtatttcagtatgtggaatcaggcggtggacagctatgatcctgatgtgcgcatcattgaaaatcatggtatagaagatgagcttcccaactattgctttcctattgacgctgtgggtattactagaacttatcaaggtatcaaaacgcaaaatggtcaaactacaacttgggaaaaggacaccagtgttagtacggccaatgaaataggcattggcaacaatcttgccatggaaatcaacatccaagccaacctgtggaggaacttcctctacgccaacgtggccctgtacctgcccgattcttacaagtacacaccggccaacgtcaccctgcccaccaataccaacacctacgattacatgaacggccgggtggtggcgccctcgctggtggacgcctacatcaacatcggggcgcgctggtcgctggaccccatggataacgtgaatcccttcaaccaccaccgcaacgcggggctgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagaccaaggagacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccagggccagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcttgcttcttgcaagctgctatggcctgtgggtcctcgcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgtcgcagcgccctggccaccgaggaccgctgcatcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaaaccgtgtgtgtatgttaaaatatcttttaataaacagcactttcatgttacacatgcatctgagatgatttatttagaaatcgaaagggttctgccgggtctcggcatggcccgcgggcagggacacgttgcggaactggtacttggccagccacttgaactcggggatcagcagtttcggcagcggggtgtcggggaaggagtcggtccacagcttccgcgtcagttgcagggcgcccagcaggtcgggcgcggagatcttgaaatcgcagttgggacccgcgttctgcgcgcgagagttgcggtacacggggttgcagcactggaacaccatcagggccgggtgcttcacgctcgccagcaccgtcgcgtcggtgatgctctccacgtcgaggtcctcggcattggccatcccgaagggggtcatcttgcaggtctgccttcccatggtgggcacgcagccgggcttgtggttgcaatcgcagtgcagggggatcagcatcatctgggcctggtcggcgttcattcccgggtacatggccttcatgaaagcctccaattgcctaaaagcttgctgggccttggctccctcggtgaagaagaccccgcaggacttgctagagaactggttggtggcgcacccggcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcatgtgctccttctggatcatggtggttccgtgcaggcaccgcagcttgccctcggcctcggtgcatccgtgcagccacagcgcgcacccggtgcactcccagttcttgtgggcgatctgggaatgcgcgtgcacgaacccctgcaggaagcggcccatcatggtcgtcagagtcttgttgctagtgaaggtcagcgggatgccgcggtgctcctcattgatgtacaggtggcagatgcggcggtacacctcgccctgctcgggcatcagctggaaattggctttcaggtcggtctccacgcggtagcggtccatcagcatagtcatgatttccatgcccttctcccaggccgagacgatgggcaggctcatagggttcttcaccatcatcttagcactagcagccgcggccagggggtcgctctcgtccagggtctcaaagctccgcttgccgtccttctcggtgatccgcaccggggggtagctgaagcccacggccgccagctcctcctcggcctgtctttcgtcctcgctgtcctggctgacatcctgcaggaccacatgcttggtcttgcggggtttcttcttgggcggcagcggtggtggagatgcttgtggcgagggggagcgcgagttctcgctcaccactactatctcttcctcttcttggtccgaggccacgcggcggtaggtatgtctcttcgggggcagaggcggaggcgacgggctctcgccgccgcgacttggcggatggctggcagagccccttccgcgttcgggggtgcgctcccggcggcgctctgactgacttcctccgcggccggccattgtgttctcctagggaggaacaacaagcatggagactcagccatcgccaacctcgccatctgcccccaccaccgccgacgagaagcagcagcagcagaatgaaagcttaaccgctccgccgcccagccccgccacctccgacgcggcggtcccagacatgcaagagatggaggaatccatcgagattgacctgggctatgtgacgcccgcggagcacgaggaggagctggcagtgcgctttcaatcgtcaagccaggaagataaagaacagccagagcaggaagcagagaacgagcagagtcaggctgggctcgagcatgacggcgactacctccacctgagcggaggggtggacgcgctcatcaagcatctggcccgacaggccatcatcgtcaaggacgcgctgctcgaccgcaccgaggtgcccctcagcgtggaggagctcagccgcgcctacgagctcaacctcttctcgccgcgtgtgccccccaagcgccagcccaacggcacctgcgagcccaacccgcgcctcaacttctacccggttttcgcggtgcccgaggccctggccacctaccacatcttttttaagaaccaaaagatccccgtctcctgccgcgccaaccgcacccgcgccgacgcccttttcaacctgggccccggcgcccgcctacctgatatcgcctccttggaagaggttcccaagatcttcgagggtctgggcagcgacgagactcgggccgcgaacgctctgcaaggagaaggaggagagcatgagcaccacagcgccctggtcgagttggaaggcgacaacgcgcggctggcggtgctcaaacgcacggtcgagctgacccatttcgcctacccggctctgaacctgccccccaaagtcatgagcgcggtcatggaccaggtgctcatcaagcgcgcgtcgcccatctccgaggacgagggcatgcaagactccgaggagggcaagcccgtggtcagcgacgagcagctggcccggtggctgggtcctaatgctacccctcagagtttggaagagcggcgcaagctcatgatggccgtggtcctggtgaccgtggagctggagtgcctgcgccgcttcttcgccgacgcggagaccctgcgcaaggtcgaggagaacctgcactacctcttcaggcacgggttcgtgcgccaggcctgcaagatctccaacgtggagctgaccaacctggtctcctacatgggcatcttgcacgagaaccgcctggggcagaacgtgctgcacaccaccctgcgcggggaggcccggcgcgactacatccgcgactgcgtctacctctacctctgccacacctggcagacgggcatgggcgtgtggcagcagtgtctggaggagcagaacctgaaagagctctgcaagctcctgcagaagaacctcaagggtctgtggaccgggttcgacgagcgcaccaccgcctcggacctggccgacctcatcttccccgagcgcctcaggctgacgctgcgcaacggcctgcccgactttatgagccaaagcatgttgcaaaactttcgctctttcatcctcgaacgctccggaatcctgcccgccacctgctccgcgctgccctcggacttcgtgccgctgaccttccgcgagtgccccccgccgctgtggagccactgctacctgctgcgcctggccaactacctggcctaccactcggacgtgattgaggacgtcagcggcgagggcctgctcgagtgccactgccgctgcaacctctgcacgccgcaccgctccctggcctgcaacccccagctgctgagcgagacccagatcatcggcaccttcgagttgcaagggcccagcgatgagggttcagccaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggcgatcctggcccaattgcaagccatccagaaatcccgccaagaattcttgctgaaaaagggccgcggggtctacctcgacccccagaccggtgaggagctcaaccccggtttcccccaggatgccccgaggaaacaagaagctgaaagtggagctgccgcccgtggaggatttggaggaagactgggagagcagcagtcaggcagaggagatggaggaagactgggacagcactcaggcagaggaggacagcctgcaagacagtctggaagacgaggaggtggcagaggaggaggtggaagaagcagccgccgccagaccgtcgtcctcggcggaggagaaagcaagcagcacggataccatctccgctccgggtcggggtcccgctcgaccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaacttcccccgcaacatcttgcattactaccgtcacctccacagcccctactacttccaagaagaggcagcagcagaaaaagaccatcagcagaaaaccagctagaaaatccacagcggcaggtggactgaggatcgcggcgaacgagccggcgcagactcgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcacctgtgcccttcgccctagccgcctccacccatcatcatgagcaaagagattcccacgccttacatgtggagctaccagccccagatgggcctggccgccggcgccgcccaggactactccacccgcatgaattggctcagcgccgggcccgcgatgatctcacgggtgaatgacatccgcgcccaccgaaaccagatactcctagaacagtcagcgctcaccgccacgccccgcaatcacctcaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccggggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttnactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggacctcgccgagttcacctactttgagctgcccgaggagcatcctcagggcccggcccacggagtgcggatcgtcgtcgaagggggcctagactcccacctgcttcgtatcttcagccagcgcccgatcctggtcgagcgccaacagggcaacaccctcctgaccctctactgcatctgcgaccaccccggcctgcatgaaagtctttgttgtctgctgtgtactgagtataataaaagctgagatcagcgactactccggactcaactgtggtgtttctgcatccatcaaccggtctctgaccttcaccgggaacgagaccgagctccagctccagtgtaagccccacaagaagtacctcacctggctgtaccagggctccccgatcgccgttgttaaccactgcgacgacgacggagtcctgctgaacggccccgccaaccttactttttccacccgcagaagcaagctactgctcttccgacccttcctccccggcacctatcagtgcatctcgggaccctgccatcacaccttccacctgatcccgaataccacctcttccccagcgccgctccccactaacaaccaaactaaccaccaacgctaccgacgcgacctcgtttctgaatctaataccacccacaccggaggtgagctccgaggtcctgattcctctgggatttattacggcccctgggaggtggtggggttaatagctttaggcttagtggcgggtgggcttttggctctctgctacctatacctcccttgcttttcctacttagtggtgctttgttgctggtttaaaaaatggggaagatcaccctagtgtgcggtgtgctggtgacggtggtgctttcgattctgggagggggaagcgcggctgtagtgacggagaagaaggccgatccctgcttgactttcaaccccgataaatgccagctgagttttcagcccgaaggcaatcggtgcatagtgctgatcaagtgcggatgggaatgcaaggatgtgagaatccagcacaataacaagacgcggaacaatactctcgcgtccacatggcagcccggggaccccgagtggtacaccgtctctgtccctggtgctgacggctccctccgcacggtgaacaacactttcatttttgagcacatgtgcgaaaccgccatgttcatgagcaagcagtacggcatgtggcctccgcgtaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacattcacacaccttgttttttacagacaatgcgtctgttaatttttgttatcattacactcagcattaataatgcccatggctatgcaaatatacaaaaaaccctctatgtaggctctgactctacattagaaggtactcaatctcaagccagggtttcatggtatttttataaaggcaatgataaaccaattactctttgcaaaggtgatcaggggcgcataacaaagccacctatcacatttagctgcaccagaacaaacctcacgcttttatccattacaaaacaatatgctggcacttattacagcacaaattttcatagtgggcaagataaatattatactgttaaggtagaaaaccctactacccctagaacaactacaaagcccaccacaactaagaagcccactacacctaagaagcctaccacgcccaaaaccactaagacaacaactactaagaccactaccacagagccaaccacgaccagcaccacacttgctataactacacacacacacactgagctgacctcgcaggcaactactgaaaatggttttgccctactgcagaagggggagaacagtagcagcagtcttatgcctactacccccagtgaggaaatacccaagtccatggttggcattatcgctgctgtagtggtgtgtatggtgattatcatcttgtgcatgatgtactatgcctgctactacagaaaacacaggctgaacaacaagctggaccccctactgaatgttgatttttaattttttagaaccatgaagatcctaagcctttttgttttttctataattattacctctgctatttgtgaatcagtggataaggacgttactgtcaccactggctctaattatacactaaaagggccttcctcaggtatgctttcgtggtattgttattttggaaatgatgataaacagacagagctatgtaattttcagaacggcaaaaccaaaaattctaaaatagataactatcaatgccagggtactgatttagtactgatgaatatcacgaaagcatatgctggcagttattcatgtcctggacaaaacaccgaggaaatgattttttacaaattaattgtagttgaccctactactccagcaccaaccaccacaactaccaaggcacataccacagacacacaggaaaccactccagaggcagaagcagagatagcaaagcagattcatgaagattcctttgttgccaatacccccacacaccccggaccgcaatgtccagggccattagtcagcggcattgtcggtgtgctttgcgggttagcagttataatcatctgcatgttcatttttgcttgctgctacagaaggcttcaccgacaaaaatcagacccactgctgaacctctatgtttaatttttgattttccagagccatgaaggcacttagcactttagtatttttgtccttgattggcattgtttttactagtcaaattaccagggttagatttatcaaatatgttaatgttactgaaggagataatatcacactagcaggtgtagaaggtgcccaaaacaccacctggacaaaataccatctcgggtggaaagatatttgcacctggaatgtcacttatttttgcataggagttaatcttaccattgtcaatgctaatcaatctcagaatggattaattaaaggccaaagtgttagtgtgaccagtgatgggtattatacccagcatagtttcaactacaacatcactgtcataccactgcccacacctagtccacctagcactactcaaaccacacaaacaactcacactacacagaactccacaactaccatgcagaccactcagacaactacatcccctcagcccaccaccactacagcagaggcgagtagctcacctaaaattgaagtggcatttttgttactgccaccatctagcagtcccactgctagtaccaatgagcagactactgaatttttgtccactactcagagcagcaccacagctacctcgagtgccttctctagcaccgccaatctcacctcgctttcctctacgccaatcagtaacgctactacctcccccgctcctcttcccactcctctgaagcaatccgagtctagcacgcagctgcagatcaccctgctcattgtgatcggggtggtcatcctggcagtgctgctctactttatcttctgccgccgcatccccaacgcgaaaccggcctacaagcccattgttatcgggacgccggagccgcttcaggtggagggaggtctaaggaatcttctcttctcttttacagtatggtgatttgaactatgattcctagacatttcattatcacttctctaatctgtgtgctccaagtctgtgccaccctcgctctcgtggctaacgcgagtccagactgcattggagcgttcgcctcctacgtgctctttgccttcatcacctgcatctgctgctgtagcatagtctgcctgcttatcaccttcttccagttcgttgactgggtctttgtgcgcatcgcctacctgcgccaccatccccagtaccgcgaccagagagtggcgcaactgttgaggctcatctgataagcatgcgggctctgctactcctcgcgcttgcactagctcccctcgccgcccccttaaccttcaaatcccccacccagtcccccgaagaggttcgaaaatgtaaattccaagaaccctggaaattcctcaaatgctaccagctcaaatcagaaatgcaccccagctggatcatgatcattggaatcgtgaacatccttgcctgtactctcatctcctttgtgatttacccctgctttaactttgggtggaacgcacccgaggcgctctggctcccgcctgatcccgacacaccaccacagcagcagcaaaatcaggcacacgcaccaccacagcctaggccacaatacatgcccatcttagactatgaggccgagccacagcgagccatgcttcctgctattagttacttcaatctaaccggcggagatgactgaccccatggccaacaacaccgtcaacgacctcctggacatggacggccgcggctcggagcagcgactcgcccaactccgcatccgccagcagcaggagagagccgtcaaagagctgcaggatgcggtggccatccaccagtgcaagaaaggcatcttctgcctggtgaagcaggccaagatcaccttcgaggtgacttccaccgaccatcgcctctcctacgagctcctgcagcagcgccagaagttcacctgcctggtcggagtcaaccccatcgtcatcacccagcagtctggcgataccaaggggtgcatccactgctcctgcgactcccccgagtgcgttcacaccatgatcaagaccctctgcggcctccgcgacctcctccccatgaactaatcaactaacccctaccccctttaccctcaagtaaaaataaagattaaa

SEQ ID NO: 294 - protein, 134 aa, Artificial Sequence; identical to SEQ ID NO: 136
  Synthetic Construct

SEQ ID NO: 295 - DNA, 38703 bp, Artificial Sequence
  Simian adenovirus A1322 clone
  misc_feature (5)..(12): Swa\I
  repeat_region (16)..(104): ITR
  misc_feature (443)..(468): I-Ceu\recognition site
  misc_feature (456)..(457): cleavage point for bottom strand
  misc_feature (460)..(461): cleavage point for top strand
  enhancer (810)..(1070): Enhancer
  misc_feature (1071)..(1298): CMV promoter
  TATA_signal (1272)..(1275): TATA
  CDS (1394)..(2485): Gag\short
  polyA_signal (2638)..(2840): BGH-PolyA
  misc_feature (2913)..(2951): PI-Scel recognition site
  misc_feature (2923)..(2924): cleavage point on bottom strand
  misc_feature (2927)..(2928): cleavage point on top strand
  CDS (2952)..(3344): E1b\55K
  CDS (3429)..(3542): pIX
  misc_feature (3916)..(5540): IVa2    complement (3916..5249,5528..5540)
  misc_feature (8372)..(8373): n is a, c, g, or t
  misc_feature (8375)..(8378): n is a, c, g, or t
  misc_feature (8384)..(8384): n is a, c, g, or t
  misc_feature (8879)..(8879): n is a, c, g, or t
  misc_feature (8891)..(8891): n is a, c, g, or t
  misc_feature (9047)..(9047): n is a, c, g, or t
  misc_feature (9743)..(9743): n is a, c, g, or t
  misc_feature (9797)..(9797): n is a, c, g, or t
  misc_feature (9827)..(9827): n is a, c, g, or t
  misc_feature (9836)..(9836): n is a, c, g, or t
  misc_feature (9920)..(9920): n is a, c, g, or t
  CDS (10790)..(11971): 52K
  misc_feature (12273)..(17687): pTP    complement (12273..14216,17679..17687)
  misc_feature (12273)..(21064): pol    complement (12273..15851,21056..21064)
  CDS (13855)..(15483): penton
  CDS (15487)..(16068): pVII
  CDS (16110)..(17147): V
  CDS (17168)..(17401): pX
  CDS (17433)..(18206): pVI
  CDS (21157)..(21786): protease
  misc_feature (21865)..(23403): DBP    complement (21865..23403)
  CDS (23426)..(25819): 100K
  CDS (26427)..(27107): pVIII
  CDS (27111)..(27428): E3\12.5K
  CDS (27990)..(28514): E3\gp19K
  CDS (28554)..(29273): E3\CR1-beta
  CDS (29289)..(29909): E3\CR1-gamma
  CDS (30819)..(31091): E3\RID-alpha
  CDS (31527)..(31931): E3\14.7K
  CDS (32187)..(33512): fiber
  misc_feature (33639)..(34801): E4\orf6/7    complement (33639..33890,34616..34801)
  misc_feature (33887)..(34801): E4\orf6    complement (33887..34801)
  misc_feature (34692)..(35057): E4\orf4    complement (34692..35057)
  misc_feature (35066)..(35419): E4\orf3    complement (35066..35419)
  misc_feature (35416)..(35805): E4\orf2    complement (35416..35805)
  misc_feature (35856)..(36233): E4\orf1    complement (35856..36233)
  repeat_region (36570)..(36630): ITR  complement (36570..36630)
  misc_feature (36634)..(36641): Swa\I
  rep_origin (36879)..(36879): ORI
  misc_feature (37883)..(38500): AP(R)    complement (37883..38500)
aattatttaaatcccggtgcgcgttatatgcaaatgaggcgtttgaatttgggaattcggggcgctgattggccgctggggccggcgaccgttaggggcggggcgagtgacgtttggatgacgtggtcgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggtagggaggagtatttgccgagggccgagtagactttgaccgattacgtgggggtttcgattaccgtgtttttcacctaaatttccgcgtacggtgtcaaagtccggtgtttttacgtaactataacggtcctaaggtagcgaaagctcagatctggatctcccgatcccctatggcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacagagagatgggtgcgagagcgtcagtattaagcgggggagaattagatcgatgggaaaaaattcggttaaggccagggggaaagaagaagtacaagctaaagcacatcgtatgggcaagcagggagctagaacgattcgcagttaatcctggcctgttagaaacatcagaaggctgtagacaaatactgggacagctacaaccatcccttcagacaggatcagaggagcttcgatcactatacaacacagtagcaaccctctattgtgtgcaccagcggatcgagatcaaggacaccaaggaagctttagacaagatagaggaagagcaaaacaagtccaagaagaaggcccagcaggcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaggacctgaacacgatgttgaacaccgtggggggacatcaagcagccatgcaaatgttaaaagagaccatcaatgaggaagctgcagattgggatagagtgcatccagtgcatgcagggcctattgcaccaggccagatgagagaaccaaggggaagtgacatagcaggaactactagtacccttcaggaacaaataggatggatgacaaataatccacctatcccagtaggagagatctacaagaggtggataatcctgggattgaacaagatcgtgaggatgtatagccctaccagcattctggacataagacaaggaccaaaggaaccctttagagactatgtagaccggttctataaaactctaagagctgagcaagcttcacaggaggtaaaaaattggatgacagaaaccttgttggtccaaaatgcgaacccagattgtaagaccatcctgaaggctctcggcccagcggctacactagaagaaatgatgacagcatgtcagggagtaggaggacccggccataaggcaagagttttgtagggatccactagttctagactcgagggggggcccggtacctttaagaccaatgacttacaaggcagctgtagatcttagccactttttaaaagaaaaggggggactggaagggctaattcactcccaaagaagacaagataaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcacatatgctagccaccgtgcatgtggcctcccatgctcgcaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggatgtgtggaagattctgagatatgatgaatccaagaccaggtgccgagcctgcgagtgcggagggaagcatgccaggttccagcccgtgtgtgtggatgtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagcatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctactacggcactctggtggccaactcgagttccaccaataatcccgccagcctgaacgaggagaagctgctgctgctgatggcacagctcgaggccttgacccagcgcctgggcgagctgacccagcaggtggctcagctgcaggagcagacgcgggctgcggttgccacggtgaaatccaaataaaaaatgattcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgttgcacaatatctttgaggaggagactgatggccacgggcagccctttggtgtaggtgtttacaaatctgttaagctgggagggatgcatgcggggggagatgaggtgcatcttggcctggatcttgagattggcgatgttgccgcccagatcccgcctggggttcatgttgtgcaggaccaccagcacggtgtatccggtgcacttggggaatttatcatgcaacttggaagggaaggcgtgaaagaatttggcgacgcccttgtgcccgcccaggttttccatgcactcatccatgatgatggcgatgggcccgtgggcggcggcctgggcaaagacgtttcgggggtcggacacatcatagttgtggtcctgggtgagatcatcataggccattttaatgaatttggggcggagggtgcccgattgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttgcggagcagctgtgacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacaagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccagccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagagcagcttggcgatggagcgcatggtctggttcttttccttgtcggcgcgctccttggcggcgatgttgagctgcacgtactcgcgcgccacgcacttccattcggggaatacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagatcgtccagacttgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgtgccgagattggagcgctgcggcttttcggcgcggtagacgatctggcggaagatggcgtgggagttggaggagatggtgggcctctggaagatgttgaagtgggcgtggggcagtccgaccgagtccctgatgaagtgggcgtaggagtcctgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagggcccagtcggcgacgtgggggttggcgcggaggaaggaagtccagagatccacagccagggcggtctgcaagcggtcccggtactgacggaactgctggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctggtgctgtactacgtcctggccatcggcgtggccatcgtctgcctcgatggtggtcatgctgacgagcccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtgccgtgcccctggggcgccaccaccgtgccccgtttcttcttgggcgctggcgnngnnnncgctgnttccatgtcggtcagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcnaggttgagctcnacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtanaagtccacggcgaagttgaaaaactgggagttgcgcgccgagacggtcaactcctcctccagaagacggatgagctcggcgatggtggcgcgcacctcgcgctcgaaggccccggggggctcctcttcttccatctcctcctcctcttcctcctccactaacatctcttctacttcctcctcaggaggcggcggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcacggtttcttctggcgggtcatgttggttggagggagcggggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcnaggtccttgtagtagtcctgcatgagccgctccacgggcacctcctcctcgccngcgcggccgtgcatgcgcgtgagcccgaanccgcgctgnggctggacgagcgccaggtcggcgacgacgcgctcggcgaggatggcctgctggatctgggtgagggtggtctggaagtcgtcnaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgctaacgaaacctccaggatacggaggcgggtcgttttttggccttggccgctggtcatgaaaaactagtaagcgcggaaagcggccgtccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttcttgtgtttttgccagatgcatcccgtactgcggcagatgcgcccccaccctccaccacaaccgcccctaccgccgcagcagcagcaacagccggcgcttctgcccccgccccagcagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaagcggcggcaggaccctacgtagaagaggtggacgatgaggtggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccctggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggcgttcaagaacttgcagggattgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccattggccaggcgcacgtggacgagcagacctaccaggagatcacccacgtgagccgcgcnctgggccaggacgacccgggcaatctggaagccaccctgaacttcttgctgaccaaccggtcgcagaagatcccgccccagtacgcgctcagcgccgaggaggagcgcatcctgcgatacgtgcagcagagcgtgggcctgttcctgatgcaggagggggccacccccagcgccgcgctcgacatgaccgcgcgcaacatggagcccagcatgtacgccagcaaccgcccgttcatcaataagctgatggactacttgcatcgggcggccgccatgaactctgactatttcaccaatgctattttgaacccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgctcgtcctcggcgctgtccggccgcgagggtgctgccgcggcggtgcccgaggccgccagtccgttcccgagcttgcccttctcgctgaacagcattcgcagcagcgagctgggcaggatcacgcgcccgcgcttgctgggcgaggaggagtacttgaatgactcgctgttgagacccgagcgggagaagaacttccccaataacgggatagagagcctggtggacaagatgagccgctggaagacgtatgcgcaggagcacagggacgatccccgggcgtcgcagggggccacgagccggggcagcgccgcccgtaaacgccggtggcacgacaggcagcggggactgatgtgggacgatgaggattccgccgacgacagcagcgtgttggacttgggtgggagtggtggtggtaacccgttcgctcacctgcgcccccgcatcgggcgcatgatgtaagaaaccgaaaataaatggtactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagaccccaaacggggtgacagtagatgagaattatgatggtagtcaggatatcttggagtatgagtgggtggagtttgagctgcccgaaggcaacttctcggtgaccatgaccatcgacctgatgaacaacgccatcatcgacaattacttggcggtagggcggcagaacggggtgctggagagcgacatcggcgtgaagttcgacactaggaacttcaggctcggttgggaccccgtgaccgagctggtcatgcccggggtgtacaccaacgaggccttccaccccgatattgtcttgctgcccggctgcggggtggacttcaccgagagccgcctcagcaacctgctgggcattcgcaagaggcagcccttccaggagggtttccagatcatgtacgaggatctggaggggggcaacatccccgcactcctggatgtcgacgcctacgaggaaagcaaggaaaaagcagaagccgaggcgaccgcagccgtgactaccgccgcgaccaccaatgcagatgcaactaccaccagaggcgatacattcgccactcaggcggaggaagcagccgccctagcggtcgccgatgatagcgaaagtaagatagtcattcagccagtgaagaaggatagcaagaacagaagttacaacgtgctgccggacgaggtaaacaccgcctaccgcagctggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacncccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggcggtgaaggaggaaagaaagccccgcaaaatcaagcgggtcaaaaaggacaaaaaggaagaagatgacgatctggtggagtttgtgcgcgagttcgccccccggcggcgcgtgcagtggcgcgggcggaaagtgcgtccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgctccgcgccgaaggaagaggcggtgtccatcccgctggaccacggcaaccccacgccgagcctcaagcccgtgaccctgcagcaggtgctgccgagcgcggcgccgcgaagggggttcaagcgcgagggcgaggatctgtaccccaccatgcagctgatggtgcccaaacgccagaagctggaagacgtgctggaaaccatgaaggtggacccggacgtgcagcccgaggtcaaggtgcggcccatcaagcaggtggccccgggtctgggcgtgcagaccgtggacatcaagatccccacggagcccatggaaacgcagaccgagcccatgatcaagcccagtaccagcaccatggaggtgcagacggatccctggatgccggctgcccccaccaccagcagccgaagaccccggcgcaagtacggcgcggccagcctgctgatgcccaactacgcgctgcatccttccatcatccccacgccgggctaccgcggcacgcgcttctaccgcggtcatacaaccagctcccgccgccgcaagaccaccactcgccgccgccgtcgccgcaccgccgctgcatctacccccgccgccctggtgcggagagtgtaccgccgcggccgcgcgcctctgaccctgccgcgcgcgcgctaccacccgagcatcgccatttaaaactttcgcctgctttgcagatggccctcacatgccgcctccgcgttcccattacgggctaccgaggaagaaaaccgcgccgtagaaggctggcggggaacgggatgcgtcgccaccaccatcggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgaaaagcgaccccgccccgacgcggaggaaacgctgctgacgcacacggacgagccgcccccgtacgaggaggcggtgaaactgggtctgcccaccacgcggcccatcgcgcccctggccaccggggtgctgaaacccgaaactaagcccgcgaccctggacttgcctcctcccgcttcccgtccctccacagtggctaagcccctgccgccggtggccgtggcccgcgcgcgacccgggggctccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaatgctctggctcctaaagctgctcctaatcctagtcagtggaatgaaaccactgagggaacgaatggaaatgctgatgccactactactaaacatagttttggattggctgccatgaagggtgataatatcgcggctgaagggctgcagataggaacagattctacctctggaaccgatacacctatctatgcagataagctgtatcagccagagcctcagataggagaggaatcatggacagataacgatggaaccaatgaaaaatttggaggaagagttcttaagcccgataccaacatgaaaccctgctatgggtcctttgccaagcccactaataacaaaggtggtcaagcaaaacaaaaggcaacagaaggaacagctgtggattatgatgttgacatgaactttttcgatggtagagatgcagctgctaactttactccagaagtagtgttgtatgctgaaaatgtggatttggagactccagatacccatattgtatacaaaccaggaacttcagatctgagttcccatgtaaatttgggtcaacaggccatgcccaacagacccaactacatcggcttcagagacaactttatcggcctcatgtactacaacagcactggcaatatgggggtgctggctggtcaggcctcccagctgaatgctgtggttgacttgcaagacagaaacaccgagctgtcataccagctcttgcttgactctctgggtgacagaacccggtatttcagcatgtggaaccaggcggtggacagttatgaccccgatgtgcgcattattgaaaaccatggtatagaagatgaacttcccaactactgtttcccaattgatgctgtgggcattaccagaacctatcaaggcataaaagtacaaaatggaactggcactggaacgacatgggaaaaagatactgatgttagtacagcaaatgaaataggcattggcaacaatcttgccatggaaatcaacatccaagccaacctgtggaggaacttcctttactcgaacgtggctctgtacctgcccgattcttacaagtacacaccggccaacgtcaccctgcccaccaacaccaacacctacgattacatgaacggccgggtggtggcaccttcgctggtggacgcctacatcaacatcggggcgcgctggtcgctggaccccatggacaacgtcaatcccttcaaccaccaccgcaacgcgggcttgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcttccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggaaacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccaggggcagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcgtcttgctacttgcatgatggctgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttactgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaaaccgtgtgtgtatgtgaatgctttattcataataaacagcacatgtttatgccaccttctctgaggctctgactttatttagaaatcgaaggggttctgccggctctcggcgtgccccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcacagttgggacccgcgttctgcgcgcgagagttgcggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgttcggagctcatgcccgggtacatggccttcatgaaagcctccagctggcggaaggcctgctgcgccttgccgccctcggtgaagaagaccccgcaggacttgctagagaactggttggtggcgcagcccgcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcgtgtgctccttctggatcatcacggtcccgtgcaggcaccgcagcttgccctcggcctcggtgcagccgtgcagccacagcgcgcagccggtgctctcccagttcttgtgggcgatctgggagtgcgagtgcacgaagccctgcaggaagcggcccatcatcgcggtcagggtcttgttgctggtgaaggtcagcgggatgccgcggtgctcctcgttcacatacatgtggcagatgcggcggtacacctcgccctgctcgggcatcagctggaaggcggacttcaggtcgctctccacgcggtaccgttccatcagcagcgtcatgacttccatgcccttctcccaggccgaaacgatcggcaggctcagggggttcttcaccgccattgtcatcttagtcgccgccgccgaggtcagggggtcgttctcgtccagggtctcaaacactcgcttgccgtccttctcggtgatgcgcacgggggggaaggcgaagcccacggccgccagctcctcctcggcctgcctttcgtcctcgctgtcctggctgatgtcttgcaaaggcacatgcttggtcttgcggggtttctttttgggcggcagaggcggcggcgatgtgctgggcgagcgcgagttctcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaagcatggagactcagccatcgtcgccaacatcgccatctgcccccgccgccaccgccgacgagaaccagcagcagcagaatgaaagcttaaccgccccgccgcccagccccacctccgacgccgcggccccagacatgcaagagatggaggaatccatcgagattgacctgggctacgtgacgcccgcggagcacgaggaggagctggcagcgcgcttttcagccccggaagaaaaccaccaagagcagccagagcaggaagcagagagcgagcagaaccaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccacgcgtgccccccaagcgccagcccaacggcacctgcgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcacctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggaacgagtagcaccccccagagtctggaagagcggcgcaagctcatgatggccgtggtcctggtgaccgtggagcttgagtgtctgcgccgcttctttgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcaaaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgtaccaccgcctcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacctgctgcgcctggccaactacctggcctaccactcggacgtgatcgaggacgtcagcggcgagggtctgctcgagtgccactgccgctgcaacctctgcacgccgcaccgctccctggcctgcaacccccagctgctgagcgagacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccggaggatttggaggaagactgggagagcagtcaggcagaggagatggaagactgggacagcactcaggcagaggaggacagcctgcaagacagtctggaggaggaagacgaggtggaggaggaggcagaggaagaagcagccgccgccagaccgtcgtcctcggcggaggagaaagcaagcagcacggataccatctccgctccgggtcggggtcccgctcggccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaacttcccccgcaacatcttgcattactaccgtcacctccacagcccctactacttccaagaagaggcagcagaaaaagaccagaaaaccagctagaaaatccacagcggcggcagcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcaccacctgcgcccttcgcccgaccatcatcatgagcaaagagattcccacgccttacatgtggagctaccagccccagatgggcctggccgccggcgccgcccaggactactccacacgcatgaattggctcagcgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggatctcgccgagttcacctactttgagctgcccgaggagcaccctcagggcccggcccacggagtgcggatcgtcgtcgaagggggtctcgactcccacctgcttcggatcttcagccagcgaccgatcctggtcgagcgccaacagggcaacaccctcctgaccctctactgcatctgcgaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcgcgacctttcctctgaatctaataccactaccggaggtgagctccgaggtcgaccaacctctgggatttactacggcccctgggaggtggtggggttaatagcgctaggcctagttgtgggtgggcttttggctctctgctacctatacctcccttgcttttcctacttagtggtgctttgttgctggtttaagaaatggggaagatcaccctagtgtgcggtgtgctggtgacggtggtgctttcgattctgggagggggaagcgcggctgtagtgacggagaaggccgatccctgcttgactttcaaccccgataaatgccggctgagttttcagcccgaaggcaatcggtgcatagtgctgatcaagtgcggatgggaatgcaaggatgtgaaaatccagcacaataacaagacgcggaacaatactctcgcgtccacatggcagcccggggaccccgagtggtacaccgtctctgtccctggtgctgacggctccctccgcacggtaaacaacactttcatttttgagcacatgtgcgataccgccatgttcatgagcaagcagtacggtatgtggcccccgcgaaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacacacttttttcacacaccttgtttttttacagacaatgcgtctgttaatttttgttatcattacactcagctttaactatgcccatggctatgcaaatatacaaaaaaccctctatgtaggctctgactctacattagaaggtactcaatctcaagccagggtttcatggtatttttataaaggctctgatgccccaattactctttgcaaaggtgatcatgggcgcgcaacaaagccacctatcacatttagctgcaccagaacaaacctcacgcttttatccattacaaaagaatatgctggcacttattacagcacaaattttcatagtgggcaagataaatattatactgttaaggtagaaaaccctaccacccctagaacaactacaaagcccaccacaactaagaagcccactacacctaagaagcctaccacgcccaaaaccactaagaccactaccacagagccgaccacaaccagcaccacacttgctataactacacacactgagctgacctcacaggcaactactgaaaatgatatggttgccctgttgcagaagggggaaaatagtagcagcagtcctctgcctactacccccagtgaggaaatacctaagtctatggttggcattatcgctgctgtagtggtgtgtatggtgattatcatcttgtgcatgatgtactatgcctgctactacagaaaacacaggctaaacaacaagctggaccccttactgagtgttgatttttaattttttagaaccatgaagatcctaagcctttttttgttttctataattattacctctgctctatgcaattccaacgatgacgttactgttgttgttggatcaaattatacactgaaaggacctccaaagggtatgctttcgtggtattgctggtttggaactgatgacaaacaaacagagctctgcaatcttaaaaatggaaaagtctcaaacccaaaaatctccaattatatatgcaatggcactgatttaattctgctcaatatcacgaaagcatatgctggcagttacacctgccctggagacgacactgaaaatatgatttttaaaaaattaattgtagttgaccctactactccagcaccacccaccacaacaactaccaaggcacataccacacacaaacaaactacaccagaggcagaagcagagttagcaaagcagattcaagaagattcctttgttgccaatacccccacacaccccggaccgcaatgtccagggccattagtcagcggcattgtcggtgtgctttgcgggttagcagttataatcatctgcatgttcatttttgcttgctgctacagaaggcttcaccgacaaaaatcagacccactgctgaacctctatgtttaattttttccagagccatgaaggcagttagcgctctagttttttgttctttgattggcattgtttttagtgctgggtttttgaaaaatcttaccatttatgaaggtgagaatgccactctagtgggcatcagtggtcaaaatgtcagctggctaaaataccatctagatgggtggaaagacatttgcgattggaatgtcactgtgtatacatgtaatggagttaacctcaccattactaatgccacccaagatcagaatggtaggtttaagggccagagtttcactagaaataatgggtatgaatcccataacatgtttatctatgacgtcactgtcatcagaaacgagactgccaccacacagatgcccactacacacagttctaccactactagcatgcaaaccacacagacaaccactttttatacatcaactcagcatatcaccactacagcagcaaagccaagtagcgcagcgcctcagccacaggctttggctttgaaagctgcacaacctagtacaactactaggaccaatgagcagactactgattttttgtccactgtcgagagccacaccacagctacctcgagtgccttctctagcaccgccaatctctcctcgctttcctctacaccaatcagtcccgctactactcctacccccgctcctcttcccactcccctgaagcaaacagacggcggcatgcaatggcagatcaccctgctcattgtgatcgggttggtcatcctggccgtattgctctactacatcttctgccgccgcattcccaacgcgcaccgcaagccggtctacaagcccatcgttgtcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcgtcacctgcatctgctgctgtagcatagtctgcctgcttatcaccttcttccagttcattgactggatctttgtgcgcatcgcctacctgcgccaccacccccagtaccgcgaccagcgagtggcgcagctgctcaggctcctctgataagcatgcgggctctgctacttctcgcgcttctgctgttagtgctcccccgtcccgtcgacccccggtcccccactcagtcccccgaggaggttcgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcagcaacctcaggcacacgcactaccaccaccacagcctaggccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgccagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcaacgccagaagttcacctgcctggtcggagtcaaccccatcgtcatcacccagcagtctggcgataccaagggttgcatccactgctcctgcgactcccccgagtgcgttcacaccatgatcaagaccctctgcggcctccgcgacctcctccccatgaactaatcaactaacccctaccccatttacccagatacaataaagattaaagagatgatgatttgaattgatcaataaagaatcacttacttgaaatctgaaaccaggtctctgtccatgttttctgtcagcagcacttcactcccctcttcccagctctggtactgcagaccccggcgggctgcaaacttcctccacactctgaaggggatgtcaaattcctcctgtccctcaatcttcatttttatcttctatcagatgtccaaaaagcgcgcgcgggtggatgatggcttcgaccccgtgtacccctacgatgcagacaacgcaccgactgtgcccttcatcaaccctcccttcgtctcttcagatggattccaagaaaagcccctgggggtgttgtccctgcgcctggccgaccccgtcaccaccaagaacggggctgtcaccctcaagctgggggagggagtgggcctcgactcctcgggaaaactcatatctaccactgccaccactaaagctacagcccccctcagtatttccaacaacaccatttcccttaacatggatacccctttctataccaaaaatggaaacttagctctaaacatagccgcaccgctcagagtagcagatatattaaacacattggttgtagcatatggtcaaggtttaggtttaaacaataatgcccttgctgttcaagttacatctccacttacttttgatggcaataacaggcttaagataaatttagctaatggcccactaaaggttgaagcaagcagactgtccatcaagtgccagagaggaatatatgtcaccactactggagaagcaattgaaaccaatataagctggccaagaggtattagatttgaaggcaatgctatggctgtgaacattgacaccaacaaaggcttacaatttggaactaccagtacagaaacaggagttaacaatgcttacccaattcaagttaagctaggagctggtcttagttttgacagcacaggagctattgttgcatgggacaaagcagatgacaaactcacgttgtggactactccagacccaagtccaaattgcaaaatagcatctgacaaagatgctaagcttacactttgcttgacaaaatgcggcagccaaattttaggtaccgtctccctgttagctgtcagtggcagcctagctccaattacaggagttgttaacactgcacttgtatcacttaaattcaatgccagtggagcacttttggataaatcaacacttaacaaagaatattggaattatagacaaggagatcttattccaggtactccatacactaatgccataggctttatgcctaacttaaaggcatatccaaaaaacacaagtggagcttccaaaagccacattgtaggagaagtctatctggatggggaagcagataagcctttatctcttacaatcacttttaatgaaactgatgatgaaacctgtaactattgtatcaactttcaatggaaatgggaggctgatcaatacaaagaaaagaccctcgcaaccagctcattcaccttctcctacattgcccaagaataagccgcccaactctgttacccaccctgcatgcataaccctctgtatcccacaccccctttctatggaaaactctgaagcagaaaataaagttcaagtattctttattggaatcagttatttcttttacaggatacgagtagtgattttccctccaccttcccatttcatcgagtacaccatcctctccccccgcacagccttaaacatctgtatgccattagagatggacatggttttggtctccacattccacacagtttcagagcgagccagtctcggatcggtaatggaaataaaaccctcctgacagtcctgcatagccgcctcacagtccaacagttgagggctctcctcggtggtcgggatcacagttatctggaagaagaagaacggtgggaatcataatcctggaacgggatcggccggttgtgaagcatcaaaccccggagcagtctctgtctcctgcgctccgtgcggctgctgctaatggggtccgggtccaaggactccctcagcatgaggcccacggccctcagcatcaaccgcctggtgcggcgggcgcagcagcgcatacggatctcgctcagctcggagcagtaagtgcagcacatgatcaccaggttgttcaacaaaccatagttcagagtgctccagccaaagctcatagccggcacaatgctgcccacgtgcccgtcgtaccagatcctgatgtaaatcaggtggcgacctctccaaaacacactgcccacgtacatgatctccttgggcatgtgcaggttcactacctcccggtaccacaccactcgctggttgaacatgcagccctggatgatcctgcggaaccagatggccagcaccgctccgccggccatgcaccgaaggcagccggggtcgttacagtggcagtggatcatccaccgctcgcggccgtggatcacctgggagctgaacacgtctatggtggcacagcacaggcacacgctcatgcaattccgcatcactctgagctcctccggggtaagaaccatgtcccagggtacggggaactcttgtaagacagtaaagcccgcagaacaaggcagccctcgcacacaacttacattgtgcatgctcaaggtatcgcaatcaggcagcaaggggtgatcctccaccagagaagcgcgggtctcggtctcctcacagcgtggtaagtggaccggttggtacgggtgatggcgggatgaggctaatcgtgttcgagatcgtgtcatgatgcagtctctttcggacgtcctcgtactttgcatagcagaacctggtgcgggcgctgcacactgccttccggcggcggtcgcggcgcttggaacgctcggtattccagttatagaacagccactctctcaggtggttcaacacctcctgagcctcctgggtgacaaagatcccgtcagctctgatggctctgatgatctcgacaacggtggtgtgggcccaccccagccagatgatacagttctgctgggtttcaacaacgttggggggaggaaggacaggaagaaccatggttaactttattccaaacggtcgcggagcacttcaaaacggaggtcgcgaagatggcacctctcgcccccgctgtgttggtggaaaacaacagccaggtcaaacacgacacggttttccaggtgctcgacggtggcttccagcaaagcctccacgcgcacgtccagaaacaaaaggatagcgaaagcgggagcgttttctaattcctcaatcatcatattacattcctgcaccatccccagataattttcatttttccaggtctgaatgattcgaactaattcctgaggtaagtccaagccagccattataaaaagctctcggagagcgccctccaccggcatcctcaagcacaccctcatagttgcaagagatcctgctcctctgacacctgcagcagattaagaatggcaatatcaaagtttctgccgcggaacctaagctcttccctcagcgataactgtaagtactgcttcatgtcctctctaaagtttttaaccacaggcccaccaggaatgagagaaggagaagccacagcacagttaaaccgaagtcctccccagtgagcaccagcaaatgtaagattgcaataagcatagtgagtgggagcggtgatatcgtccaaattgctggacagaaaatcgggcaggtattctctcaaaaaatcaataaaagaaaaatcctccaaatgcaggttcagagcttcggggacaatgatggaaagagtcactgagctgcgctcgaacatagctaggccttttgtttttttaaatctgtaaaaaataaaaaaagaaaatattaaaccatgctagcctgacgcacaggcgggaaaatcactctttccagcaccaggcagcccactgggtcgccggcgcggccctcgtaaaaattatcagtatgattgaaaatcatcaccgaaagctcttgtctatggcctgcatgaatgattcgagtggaggtgtagaccccggcagcgctaggatcggtcagagagaaaaagcgcccctgatagcccctcggaagctgtatgctcagcctcaaatacagcaaagcgaccccgtgcggttgcagtacgaaattctcaggagagtaaaaaatgtaattattcgactcctgaacaggcagcacagccccaggcccctccaaaaagacatataaagcgtcgccctccatcatagcttaccaagcacaacagccgcaacaggcacaagagtcagagaaaggctgagctctaaactgactacccgctctgctcaatatatagagatctgtacactgacgtaaaggccaaagtctaaaaatacccgccaaaagtcacacacgcccaacacacgccccgaaaccggtgacacactcagaaaaatacgcgcacttcctcaaacgcccaaaaacccgtcacttcccggttcccacgctacgtcatctccaggcgctttcaaaatccgtcgaccgttagtgacgtcaaaatcttgtaacggtccgaattcgaaaaacgtcacttccgctcctccagccccgcccctaacggtcgccgctcccgcagccaatcaccttcctccctccccaaattcaaatcatttaaatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaag

SEQ ID NO: 296 - protein, 363 aa, Artificial Sequence; identical to SEQ ID NO: 169
  Synthetic Construct

SEQ ID NO: 297 - protein, 130 aa, Artificial Sequence
  Synthetic Construct
HMLATVHVASHARKPWPEFEHNVMTRCNMHLGSRRGMFMPYQCNLNYVKVLLEPDAMSRVSLTGVFDMNVDVWKILRYDESKTRCRACECGGKHARFQPVCVDVTEDLRPDHLVLSCTGTEFGSSGEESD

SEQ ID NO: 298 - protein, 38 aa, Artificial Sequence
  Synthetic Construct
MSGSGSFEGGVFSPYLTGRLPSWAGVRQNVMGSTVDGR

SEQ ID NO: 299 - protein, 393 aa, Artificial Sequence; identical to SEQ ID NO: 142
  Synthetic Construct

SEQ ID NO: 300 - protein, 542 aa, Artificial Sequence; identical to SEQ ID NO: 144
  Synthetic Construct

SEQ ID NO: 301 - protein, 193 aa, Artificial Sequence; identical to SEQ ID NO: 6
  Synthetic Construct

SEQ ID NO: 302 - protein, 345 aa, Artificial Sequence; identical to SEQ ID NO: 146
  Synthetic Construct

SEQ ID NO: 303 - protein, 77 aa, Artificial Sequence; identical to SEQ ID NO: 65
  Synthetic Construct

SEQ ID NO: 304 - protein, 257 aa, Artificial Sequence; identical to SEQ ID NO: 148
  Synthetic Construct

SEQ ID NO: 305 - protein, 209 aa, Artificial Sequence; identical to SEQ ID NO: 150
  Synthetic Construct

SEQ ID NO: 306 - protein, 797 aa, Artificial Sequence; identical to SEQ ID NO: 151
  Synthetic Construct

SEQ ID NO: 307 - protein, 227 aa, Artificial Sequence; identical to SEQ ID NO: 152
  Synthetic Construct

SEQ ID NO: 308 - protein, 106 aa, Artificial Sequence; identical to SEQ ID NO: 71
  Synthetic Construct

SEQ ID NO: 309 - protein, 175 aa, Artificial Sequence; identical to SEQ ID NO: 154
  Synthetic Construct

SEQ ID NO: 310 - protein, 240 aa, Artificial Sequence; identical to SEQ ID NO: 155
  Synthetic Construct

SEQ ID NO: 311 - protein, 207 aa, Artificial Sequence; identical to SEQ ID NO: 156
  Synthetic Construct

SEQ ID NO: 312 - protein, 91 aa, Artificial Sequence; identical to SEQ ID NO: 157
  Synthetic Construct

SEQ ID NO: 313 - protein, 135 aa, Artificial Sequence; identical to SEQ ID NO: 165
  Synthetic Construct

SEQ ID NO: 314 - protein, 442 aa, Artificial Sequence; identical to SEQ ID NO: 159
  Synthetic Construct

SEQ ID NO: 315 - DNA, 31560 bp, Artificial Sequence
  Simian adenovirus A1322 clone
  misc_feature (8372)..(8373): n is a, c, g, or t
  misc_feature (8375)..(8378): n is a, c, g, or t
  misc_feature (8384)..(8384): n is a, c, g, or t
  misc_feature (8879)..(8879): n is a, c, g, or t
  misc_feature (8891)..(8891): n is a, c, g, or t
  misc_feature (9047)..(9047): n is a, c, g, or t
  misc_feature (9743)..(9743): n is a, c, g, or t
  misc_feature (9797)..(9797): n is a, c, g, or t
  misc_feature (9827)..(9827): n is a, c, g, or t
  misc_feature (9836)..(9836): n is a, c, g, or t
  misc_feature (9920)..(9920): n is a, c, g, or t
  misc_feature (12849)..(12849): n is a, c, g, or t
  misc_feature (15702)..(15702): n is a, c, g, or t
  CDS (25542)..(26084): 22K
  CDS (27385)..(28005): E3\CR1-alpha
  CDS (31100)..(31531): E3\CR1-beta
aattatttaaatcccggtgcgcgttatatgcaaatgaggcgtttgaatttgggaattcggggcgctgattggccgctggggccggcgaccgttaggggcggggcgagtgacgtttggatgacgtggtcgcgaggaggagccagtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggtagggaggagtatttgccgagggccgagtagactttgaccgattacgtgggggtttcgattaccgtgtttttcacctaaatttccgcgtacggtgtcaaagtccggtgtttttacgtaactataacggtcctaaggtagcgaaagctcagatctggatctcccgatcccctatggcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacagagagatgggtgcgagagcgtcagtattaagcgggggagaattagatcgatgggaaaaaattcggttaaggccagggggaaagaagaagtacaagctaaagcacatcgtatgggcaagcagggagctagaacgattcgcagttaatcctggcctgttagaaacatcagaaggctgtagacaaatactgggacagctacaaccatcccttcagacaggatcagaggagcttcgatcactatacaacacagtagcaaccctctattgtgtgcaccagcggatcgagatcaaggacaccaaggaagctttagacaagatagaggaagagcaaaacaagtccaagaagaaggcccagcaggcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaggacctgaacacgatgttgaacaccgtggggggacatcaagcagccatgcaaatgttaaaagagaccatcaatgaggaagctgcagattgggatagagtgcatccagtgcatgcagggcctattgcaccaggccagatgagagaaccaaggggaagtgacatagcaggaactactagtacccttcaggaacaaataggatggatgacaaataatccacctatcccagtaggagagatctacaagaggtggataatcctgggattgaacaagatcgtgaggatgtatagccctaccagcattctggacataagacaaggaccaaaggaaccctttagagactatgtagaccggttctataaaactctaagagctgagcaagcttcacaggaggtaaaaaattggatgacagaaaccttgttggtccaaaatgcgaacccagattgtaagaccatcctgaaggctctcggcccagcggctacactagaagaaatgatgacagcatgtcagggagtaggaggacccggccataaggcaagagttttgtagggatccactagttctagactcgagggggggcccggtacctttaagaccaatgacttacaaggcagctgtagatcttagccactttttaaaagaaaaggggggactggaagggctaattcactcccaaagaagacaagataaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcacatatgctagccaccgtgcatgtggcctcccatgctcgcaagccctggcccgagttcgagcacaatgtcatgaccaggtgcaatatgcatctggggtcccgccgaggcatgttcatgccctaccagtgcaacctgaattatgtgaaggtgctgctggagcccgatgccatgtccagagtgagcctgacgggggtgtttgacatgaatgtggatgtgtggaagattctgagatatgatgaatccaagaccaggtgccgagcctgcgagtgcggagggaagcatgccaggttccagcccgtgtgtgtggatgtgacggaggacctgcgacccgatcatttggtgttgtcctgcaccgggacggagttcggttccagcggggaagaatctgactagagtgagtagtgttctggggcgggggaggacctgcatgagggccagaatgactgaaatctgtgcttttctgtgtgttgcagcagcatgagcggaagcggctcctttgagggaggggtattcagcccttatctgacggggcgtctcccctcctgggcgggagtgcgtcagaatgtgatgggatctacggtggacggccggcccgtgcagcccgcgaactcttcaaccctgacctatgcaaccctgagctcttcgtcggtggacgcagctgccgccgcagctgctgcatctgccgccagcgccgtgcgcggaatggccatgggcgccggctactacggcactctggtggccaactcgagttccaccaataatcccgccagcctgaacgaggagaagctgctgctgctgatggcacagctcgaggccttgacccagcgcctgggcgagctgacccagcaggtggctcagctgcaggagcagacgcgggctgcggttgccacggtgaaatccaaataaaaaatgattcaataaataaacggagacggttgttgattttaacacagagtctgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgttgcacaatatctttgaggaggagactgatggccacgggcagccctttggtgtaggtgtttacaaatctgttaagctgggagggatgcatgcggggggagatgaggtgcatcttggcctggatcttgagattggcgatgttgccgcccagatcccgcctggggttcatgttgtgcaggaccaccagcacggtgtatccggtgcacttggggaatttatcatgcaacttggaagggaaggcgtgaaagaatttggcgacgcccttgtgcccgcccaggttttccatgcactcatccatgatgatggcgatgggcccgtgggcggcggcctgggcaaagacgtttcgggggtcggacacatcatagttgtggtcctgggtgagatcatcataggccattttaatgaatttggggcggagggtgcccgattgggggacaaaggtaccctcgatcccgggggcgtagttcccctcacagatctgcatctcccaggctttgagctcggagggggggatcatgtccacctgcggggcgataaagaacacggtttccggggcgggggagatgagctgggccgaaagcaagttgcggagcagctgtgacttgccgcagccggtggggccgtagatgaccccgatgaccggctgcaggtggtagttgagggagagacagctgccgtcctcccggaggaggggggccacctcgttcatcatctcgcgcacatgcatgttctcgcgcaccagttccgccaggaggcgctctccccccagggataggagctcctggagcgaggcgaagtttttcagcggcttgagtccgtcggccatgggcattttggagagggtctgttgcaagagttccaagcggtcccagagctcggtgatgtgctctacggcatctcgatccagcagacctcctcgtttcgcgggttgggacgactgcgggagtagggcaccagacgatgggcgtccagcgcagccagggtccggtccttccagggtcgcagcgtccgcgtcagggtggtctccgtcacggtgaaggggtgcgcgccgggctgggcgcttgcgagggtgcgcttcaggctcatccggctggtcgaaaaccgctcccgatcggcgccctgcgcgtcggccaggtagcaattgaccatgagttcgtagttgagcgcctcggccgcgtggcctttggcgcggagcttacctttggaagtctgcccgcaggcgggacagaggagggacttgagggcgtagagcttgggggcgaggaagacggactcgggggcgtaggcgtccgcgccgcagtgggcgcagacggtctcgcactccacaagccaggtgaggtcgggctggtcggggtcaaaaaccagtttcccgccgttctttttgatgcgtttcttacctttggtctccatgagctcgtgtccccgctgggtgacaaagaggctgtccgtgtccccgtagaccgactttatgggccggtcctcgagcggtgtgccgcggtcctcctcgtagaggaaccccgcccactccgagacgaaagcccgggtccaggccagcacgaaggaggccacgtgggacgggtagcggtcgttgtccaccagcgggtccaccttttccagggtatgcaaacacatgtccccctcgtccacatccaggaaggtgattggcttgtaagtgtaggccacgtgaccgggggtcccagccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagagcagcttggcgatggagcgcatggtctggttcttttccttgtcggcgcgctccttggcggcgatgttgagctgcacgtactcgcgcgccacgcacttccattcggggaatacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagatcgtccagacttgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgtgccgagattggagcgctgcggcttttcggcgcggtagacgatctggcggaagatggcgtgggagttggaggagatggtgggcctctggaagatgttgaagtgggcgtggggcagtccgaccgagtccctgatgaagtgggcgtaggagtcctgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagggcccagtcggcgacgtgggggttggcgcggaggaaggaagtccagagatccacagccagggcggtctgcaagcggtcccggtactgacggaactgctggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctggtgctgtactacgtcctggccatcggcgtggccatcgtctgcctcgatggtggtcatgctgacgagcccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtgccgtgcccctggggcgccaccaccgtgccccgtttcttcttgggcgctggcgnngnnnncgctgnttccatgtcggtcagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcnaggttgagctcnacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtanaagtccacggcgaagttgaaaaactgggagttgcgcgccgagacggtcaactcctcctccagaagacggatgagctcggcgatggtggcgcgcacctcgcgctcgaaggccccggggggctcctcttcttccatctcctcctcctcttcctcctccactaacatctcttctacttcctcctcaggaggcggcggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcacggtttcttctggcgggtcatgttggttggagggagcggggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcnaggtccttgtagtagtcctgcatgagccgctccacgggcacctcctcctcgccngcgcggccgtgcatgcgcgtgagcccgaanccgcgctgnggctggacgagcgccaggtcggcgacgacgcgctcggcgaggatggcctgctggatctgggtgagggtggtctggaagtcgtcnaagtcgacgaagcggtggtaggctccggtgttgatggtgtaggagcagttggccatgacggaccagttgacggtctggtggcccggacgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgctaacgaaacctccaggatacggaggcgggtcgttttttggccttggccgctggtcatgaaaaactagtaagcgcggaaagcggccgtccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttcttgtgtttttgccagatgcatcccgtactgcggcagatgcgcccccaccctccaccacaaccgcccctaccgccgcagcagcagcaacagccggcgcttctgcccccgccccagcagcagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcggcccggttccacgcggggcgggagctgcggcgcggcctggaccgaaagagggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccctgatcgcgcgcgaggaggtgaccctgggcctgatgcacctgtgggacctgctggaggccatcgtgcagaaccccaccagcaagccgctgacggcgcagctgttcctggtggtgcagcatagtcgggacaacgaggcgttcagggaggcgctgctgaatatcaccgagcccgagggccgctggctcctggacctggtgaacattctgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagcaggcggcgcgagctgagcgaccaggagctgatgcacagcctgcagcgggccctgaccggggccgggaccgagggggagagctactttgacatgggcgcggacctgcactggcagcccagccgccgggccttggaagcggcggcaggaccctacgtagaagaggtggacgatgaggtggacgaggagggcgagtacctggaagactgatggcgcgaccgtatttttgctagatgcaacaacagccacctcctgatcccgcgatgcgggcggcgctgcagagccagccgtccggcattaactcctcggacgattggacccaggccatgcaacgcatcatggcgctgacgacccgcaaccccgaagcctttagacagcagccccaggccaaccggctctcggccatcctggaggccgtggtgccctcgcgctccaaccccacgcacgagaaggtcctggccatcgtgaacgcgctggtggagaacaaggccatccgcggcgacgaggccggcctggtgtacaacgcgctgctggagcgcgtggcccgctacaacagcaccaacgtgcagaccaacctggaccgcatggtgaccgacgtgcgcgaggccgtggcccagcgcgagcggttccaccgcgagtccaacctgggatccctggtggcgctgaacgccttcctcagcacccagcccgccaacgtgccccggggccaggaggactacaccaacttcatcagcgccctgcgcctgatggtgaccgaggtgccccagagcgaggtgtaccagtccgggccggactacttcttccagaccagtcgccagggcttgcagaccgtgaacctgagccaggcgttcaagaacttgcagggattgtggggcgtgcaggccccggtcggggaccgcgcgacggtgtcgagcctgctgacgccgaactcgcgcctgctgctgctgctggtggcccccttcacggacagcggcagcatcaaccgcaactcgtacctgggctacctgattaacctgtaccgcgaggccattggccaggcgcacgtggacgagcagacctaccaggagatcacccacgtgagccgcgcnctgggccaggacgacccgggcaatctggaagccaccctgaacttcttgctgaccaaccggtcgcagaagatcccgccccagtacgcgctcagcgccgaggaggagcgcatcctgcgatacgtgcagcagagcgtgggcctgttcctgatgcaggagggggccacccccagcgccgcgctcgacatgaccgcgcgcaacatggagcccagcatgtacgccagcaaccgcccgttcatcaataagctgatggactacttgcatcgggcggccgccatgaactctgactatttcaccaatgctattttgaacccccactggctcccgccgccggggttctacacgggcgagtacgacatgcccgaccccaatgacgggttcctgtgggacgatgtggacagcagcgtgttctccccccgaccgggtgctaacgagcgccccttgtggaagaaggaaggcagcgaccgccgctcgtcctcggcgctgtccggccgcgagggtgctgccgcggcggtgcccgaggccgccagtccgttcccgagcttgcccttctcgctgaacagcattcgcagcagcgagctgggcaggatcacgcgcccgcgcttgctgggcgaggaggagtacttgaatgactcgctgttgagacccgagcgggagaagaacttccccaataacgggatagagagcctggtggacaagatgagccgctggaagacgtatgcgcaggagcacagggacgatccccgggcgtcgcagggggccacgagccggggcagcgccgcccgtaaacgccggtggcacgacaggcagcggggactgatgtgggacgatgaggattccgccgacgacagcagcgtgttggacttgggtgggagtggtggtggtaacccgttcgctcacctgcgcccccgcatcgggcgcatgatgtaagaaaccgaaaataaatggtactcaccaaggccatggcgaccagcgtgcgttcgtttcttctctgttgttgtatctagtatgatgaggcgtgcgtacccggagggtcctcctccctcgtacgagagcgtgatgcagcaggcgatggcggcggcggcgatgcagcccccgctggaggctccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaatgacttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtcatggtctcccgcaagaccccaaacggggtgacagtagatgagaattatgatggtagtcaggatatcttggagtatgagtgggtggagtttgagctgcccgaaggcaacttctcggtgaccatgaccatcgacctgatgaacaacgccatcatcgacaattacttggcggtagggcggcagaacggggtgctggagagcgacatcggcgtgaagttcgacactaggaacttcaggctcggttgggaccccgtgaccgagctggtcatgcccggggtgtacaccaacgaggccttccaccccgatattgtcttgctgcccggctgcggggtggacttcaccgagagccgcctcagcaacctgctgggcattcgcaagaggcagcccttccaggagggtttccagatcatgtacgaggatctggaggggggcaacatccccgcactcctggatgtcgacgcctacgaggaaagcaaggaaaaagcagaagccgaggcgaccgcagccgtgactaccgccgcgaccaccaatgcagatgcaactaccaccagaggcgatacattcgccactcaggcggaggaagcagccgccctagcggtcgccgatgatagcgaaagtaagatagtcattcagccagtgaagaaggatagcaagaacagaagttacaacgtgctgccggacgaggtaaacaccgcctaccgcagctggtacctggcctacaactatggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgcttacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgttactgacgccagacgccgcacctgcccctacgtctacaaggccctgggcatagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcggtcgcgcaccaccgtcgacgacgtgatcgaccaggtggtggccgacgcgcgcaactacacncccgccgccgcgcccgtctccaccgtggacgccgtcatcgacagcgtggtggccgacgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcttcaggcgccagcgccggcaggacccggagacgcgcggccacggcggcggcagcggccatcgccagcatgtcccgcccgcggcgagggaacgtgtactgggtgcgcgacgccgccaccggtgtgcgcgtgcccgtgcgcacccgcccccctcgcacttgaagatgttcacttcgcgatgttgatgtgtcccagcggcgaggatgtccaagcgcaaattcaaggaagagatgctccaggtcatcgcgcctgagatctacggccccgcggcggcggtgaaggaggaaagaaagccccgcaaaatcaagcgggtcaaaaaggacaaaaaggaagaagatgacgatctggtggagtttgtgcgcgagttcgccccccggcggcgcgtgcagtggcgcgggcggaaagtgcgtccggtgctgagacccggcaccaccgtggtcttcacgcccggcgagcgctccggcaccgcttccaagcgctcctacgacgaggtgtacggggatgatgatattctggagcaggcggccgagcgcctgggcgagtttgcttacggcaagcgcagccgctccgcgccgaaggaagaggcggtgtccatcccgctggaccacggcaaccccacgccgagcctcaagcccgtgaccctgcagcaggtgctgccgagcgcggcgccgcgaagggggttcaagcgcgagggcgaggatctgtaccccaccatgcagctgatggtgcccaaacgccagaagctggaagacgtgctggaaaccatgaaggtggacccggacgtgcagcccgaggtcaaggtgcggcccatcaagcaggtggccccgggtctgggcgtgcagaccgtggacatcaagatccccacggagcccatggaaacgcagaccgagcccatgatcaagcccagtaccagcaccatggaggtgcagacggatccctggatgccggctgcccccaccaccagcagccgaagaccccggcgcaagtacggcgcggccagcctgctgatgcccaactacgcgctgcatccttccatcatccccacgccgggctaccgcggcacgcgcttctaccgcggtcatacaaccagctcccgccgccgcaagaccaccactcgccgccgccgtcgccgcaccgccgctgcatctacccccgccgccctggtgcggagagtgtaccgccgcggccgcgcgcctctgaccctgccgcgcgcgcgctaccacccgagcatcgccatttaaaactttcgcctgctttgcagatggccctcacatgccgcctccgcgttcccattacgggctaccgaggaagaaaaccgcgccgtagaaggctggcggggaacgggatgcgtcgccaccaccatcggcggcggcgcgccatcagcaagcggttggggggaggcttcctgcccgcgctgatccccatcatcgccgcggcgatcggggcgatccccggcattgcttccgtggcggtgcaggcctctcagcgccactgagacacacttggaaacatcttgtaataaaccaatggactctgacgctcctggtcctgtgatgtgttttcgtagacagatggaagacatcaatttttcgtccctggctccgcgacacggcacgcggccgttcatgggcacctggagcgacatcggcaccagccaactgaacgggggcgccttcaattggagcagtctctggagcgggcttaagaatttcgggtccacgcttaaaacctatggcagcaaggcgtggaacagcaccacagggcaggcgctgagggaaaagctgaaagagcagaacttccagcagaaggtggtcgatgggctcgcctcgggcatcaacggggtggtggacctggccaaccaggccgtgcagcggcagatcaacagccgcctggacccggtgccgcccgccggctccgtggagatgccgcaggtggaggaggagctgcctcccctggacaagcggggcgaaaagcgaccccgccccgacgcggaggaaacgctgctgacgcacacggacgagccgcccccgtacgaggaggcggtgaaactgggtctgcccaccacgcggcccatcgcgcccctggccaccggggtgctgaaacccgaaactaagcccgcgaccctggacttgcctcctcccgcttcccgtccctccacagtggctaagcccctgccgccggtggccgtggcccgcgcgcgacccgggggctccgcccgccctcatgcgaactggcagagcactctgaacagcatcgtgggtctgggagtgcagagtgtgaagcgccgccgctgctattaaacctaccgtagcgcttaacttgcttgtctgtgtgtgtatgtattatgtcgccgccgccgctgtccaccagaaggaggagtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactccggcaccgcctacaatgctctggctcctaaagctgctcctaatcctagtcagtggaatgaaaccactgagggaacgaatggaaatgctgatgccactactactaaacatagttttggattggctgccatgaagggtgataatatcgcggctgaagggctgcagataggaacagattctacctctggaaccgatacacctatctatgcagataagctgtatcagccagagcctcagataggagaggaatcatggacagataacgatggaaccaatgaaaaatttggaggaagagttcttaagcccgataccaacatgaaaccctgctatgggtcctttgccaagcccactaataacaaaggtggtcaagcaaaacaaaaggcaacagaaggaacagctgtggattatgatgttgacatgaactttttcgatggtagagatgcagctgctaactttactccagaagtagtgttgtatgctgaaaatgtggatttggagactccagatacccatattgtatacaaaccaggaacttcagatctgagttcccatgtaaatttgggtcaacaggccatgcccaacagacccaactacatcggcttcagagacaactttatcggcctcatgtactacaacagcactggcaatatgggggtgctggctggtcaggcctcccagctgaatgctgtggttgacttgcaagacagaaacaccgagctgtcataccagctcttgcttgactctctgggtgacagaacccggtatttcagcatgtggaaccaggcggtggacagttatgaccccgatgtgcgcattattgaaaaccatggtatagaagatgaacttcccaactactgtttcccaattgatgctgtgggcattaccagaacctatcaaggcataaaagtacaaaatggaactggcactggaacgacatgggaaaaagatactgatgttagtacagcaaatgaaataggcattggcaacaatcttgccatggaaatcaacatccaagccaacctgtggaggaacttcctttactcgaacgtggctctgtacctgcccgattcttacaagtacacaccggccaacgtcaccctgcccaccaacaccaacacctacgattacatgaacggccgggtggtggcaccttcgctggtggacgcctacatcaacatcggggcgcgctggtcgctggaccccatggacaacgtcaatcccttcaaccaccaccgcaacgcgggcttgcgctaccgctccatgctcctgggcaacgggcgctacgtgcccttccacatccaggtgccccagaaatttttcgccatcaagagcctcctgctcctgcccgggtcctacacctacgagtggaacttccgcaaggacgtcaacatgatcctgcagagctccctcggcaacgacctgcgcacggacggggcctccatctccttcaccagcatcaacctctacgccaccttcttccccatggcgcacaacacggcttccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgtctcaagaccaaggaaacgccctcgctgggctccgggttcgacccctacttcgtctactcgggctccatcccctacctcgacggcaccttctacctcaaccacaccttcaagaaggtctccatcaccttcgactcctccgtcagctggcccggcaacgaccggctcctgacgcccaacgagttcgaaatcaagcgcaccgtcgacggcgagggctacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtggtggacgaggtcaactacaaggactaccaggccgtcaccctggcctaccagcacaacaactcgggcttcgtcggctacctcgcgcccaccatgcgccaggggcagccctaccccgccaactacccgtacccgctcatcggcaagagcgccgtcaccagcgtcacccagaaaaagttcctctgcgacagggtcatgtggcgcatccccttctccagcaacttcatgtccatgggcgcgctcaccgacctcggccagaacatgctctatgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacccccttctcggccggtaacgccaccacctaagctcgtcttgctacttgcatgatggctgagcccacgggctccggcgagcaggagctcagggccatcatccgcgacctgggctgcgggccctacttcctgggcaccttcgataagcgcttcccgggattcatggccccgcacaagctggcctgcgccatcgtcaacacggccggccgcgagaccgggggcgagcactggctggccttcgcctggaacccgcgctcgaacacctgctacctcttcgaccccttcgggttctcggacgagcgcctcaagcagatctaccagttcgagtacgagggcctgctgcgccgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttactgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaaaccgtgtgtgtatgtgaatgctttattcataataaacagcacatgtttatgccaccttctctgaggctctgactttatttagaaatcgaaggggttctgccggctctcggcgtgccccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcacagttgggacccgcgttctgcgcgcgagagttgcggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgttcggagctcatgcccgggtacatggccttcatgaaagcctccagctggcggaaggcctgctgcgccttgccgccctcggtgaagaagaccccgcaggacttgctagagaactggttggtggcgcagcccgcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcgtgtgctccttctggatcatcacggtcccgtgcaggcaccgcagcttgccctcggcctcggtgcagccgtgcagccacagcgcgcagccggtgctctcccagttcttgtgggcgatctgggagtgcgagtgcacgaagccctgcaggaagcggcccatcatcgcggtcagggtcttgttgctggtgaaggtcagcgggatgccgcggtgctcctcgttcacatacatgtggcagatgcggcggtacacctcgccctgctcgggcatcagctggaaggcggacttcaggtcgctctccacgcggtaccgttccatcagcagcgtcatgacttccatgcccttctcccaggccgaaacgatcggcaggctcagggggttcttcaccgccattgtcatcttagtcgccgccgccgaggtcagggggtcgttctcgtccagggtctcaaacactcgcttgccgtccttctcggtgatgcgcacgggggggaaggcgaagcccacggccgccagctcctcctcggcctgcctttcgtcctcgctgtcctggctgatgtcttgcaaaggcacatgcttggtcttgcggggtttctttttgggcggcagaggcggcggcgatgtgctgggcgagcgcgagttctcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaagcatggagactcagccatcgtcgccaacatcgccatctgcccccgccgccaccgccgacgagaaccagcagcagcagaatgaaagcttaaccgccccgccgcccagccccacctccgacgccgcggccccagacatgcaagagatggaggaatccatcgagattgacctgggctacgtgacgcccgcggagcacgaggaggagctggcagcgcgcttttcagccccggaagaaaaccaccaagagcagccagagcaggaagcagagagcgagcagaaccaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccacgcgtgccccccaagcgccagcccaacggcacctgcgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcacctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggaacgagtagcaccccccagagtctggaagagcggcgcaagctcatgatggccgtggtcctggtgaccgtggagcttgagtgtctgcgccgcttctttgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcaaaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgtaccaccgcctcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacctgctgcgcctggccaactacctggcctaccactcggacgtgatcgaggacgtcagcggcgagggtctgctcgagtgccactgccgctgcaacctctgcacgccgcaccgctccctggcctgcaacccccagctgctgagcgagacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccggaggatttggaggaagactgggagagcagtcaggcagaggagatggaagactgggacagcactcaggcagaggaggacagcctgcaagacagtctggaggaggaagacgaggtggaggaggaggcagaggaagaagcagccgccgccagaccgtcgtcctcggcggaggagaaagcaagcagcacggataccatctccgctccgggtcggggtcccgctcggccccacagtagatgggacgagaccgggcgattcccgaaccccaccacccagaccggtaagaaggagcggcagggatacaagtcctggcgggggcacaaaaacgccatcgtctcctgcttgcaggcctgcgggggcaacatctccttcacccggcgctacctgctcttccaccgcggggtgaacttcccccgcaacatcttgcattactaccgtcacctccacagcccctactacttccaagaagaggcagcagaaaaagaccagaaaaccagctagaaaatccacagcggcggcagcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccagtcgcagaaaaaggcgggaattacgtcaccacctgcgcccttcgcccgaccatcatcatgagcaaagagattcccacgccttacatgtggagctaccagccccagatgggcctggccgccggcgccgcccaggactactccacacgcatgaattggctcagcgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggcgggcggcgccaccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggcggtcctgactttggagagttcgtcctcgcagccccgctcgggcggcatcggcactctccagttcgtggaggagttcactccctcggtctacttcaaccccttctccggctcccccggccactacccggacgagttcatcccgaactttgacgccatcagcgagtcggtggacggctacgattgaatgtcccatggtggcgcggctgacctagctcggcttcgacacctggaccactgccgccgctttcgctgcttcgctcgggatctcgccgagttcacctactttgagctgcccgaggagcaccctcagggcccggcccacggagtgcggatcgtcgtcgaagggggtctcgactcccacctgcttcggatcttcagccagcgaccgatcctggtcgagcgccaacagggcaacaccctcctgaccctctactgcatctgcgaccaccccggcctgcatgaaagtctttgttgtctgctgtgtactgagtataataaaagctgagatcagcgactactccggacttccgtgtgttcctgaatccatcaaccagtccctgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcgcgacctttcctctgaatctaataccactaccggaggtgagctccgaggtcgaccaacctctgggatttactacggcccctgggaggtggtggggttaatagcgctaggcctagttgtgggtgggcttttggctctctgctacctatacctcccttgcttttcctacttagtggtgctttgttgctggtttaagaaatggggaagatcaccctagtgtgcggtgtgctggtgacggtggtgctttcgattctgggagggggaagcgcggctgtagtgacggagaaggccgatccctgcttgactttcaaccccgataaatgccggctgagttttcagcccgaaggcaatcggtgcatagtgctgatcaagtgcggatgggaatgcaaggatgtgaaaatccagcacaataacaagacgcggaacaatactctcgcgtccacatggcagcccggggaccccgagtggtacaccgtctctgtccctggtgctgacggctccctccgcacggtaaacaacactttcatttttgagcacatgtgcgataccgccatgttcatgagcaagcagtacggtatgtggcccccgcgaaaagagaatatcgtggtcttctccatcgcttacagcgcgtgcacggtgctaatcaccgcgatcgtgtgcctgagcattcacatgctcatcgctattcgccccagaaataatgccgagaaagagaaacagccataacacacttttttcacacaccttgtttttttacagacaatgcgtctgttaatttttgttatcattacactcagctttaactatgcccatggctatgcaaatatacaaaaaaccctctatgtaggctctgactctacattagaaggtactcaatctcaagccagggtttcatggtatttttataaaggctctgatgccccaattactctttgcaaaggtgatcatgggcgcgcaacaaagccacctatcacatttagctgcaccagaacaaacctcacgcttttatccattacaaaagaatatgctggcacttattacagcacaaattttcatagtgggcaagataaatattatactgttaaggtagaaaaccctaccacccctagaacaactacaaagcccaccacaactaagaagcccactacacctaagaagcctaccacgcccaaaaccactaagaccactaccacagagccgaccacaaccagcaccacacttgctataactacacacactgagctgacctcacaggcaactactgaaaatgatatggttgccctgttgcagaagggggaaaatagtagcagcagtcctctgcctactacccccagtgaggaaatacctaagtctatggttggcattatcgctgctgtagtggtgtgtatggtgattatcatcttgtgcatgatgtactatgcctgctactacagaaaacacaggctaaacaacaagctggaccccttactgagtgttgatttttaattttttagaaccatgaagatcctaagcctttttttgttttctataattattacctctgctctatgcaattccaacgatgacgttactgttgttgttggatcaaattatacactgaaaggacctccaaagggtatgctttcgtggtattgctggtttggaactgatgacaaacaaacagagctctgcaatcttaaaaatggaaaagtctcaaacccaaaaatctccaattatatatgcaatggcactgatttaattctgctcaatatcacgaaagcatatgctggcagttacacctgccctggagacgacactgaaaatatgatttttaaaaaattaattgtagttgaccctactactccagcaccacccaccacaacaactaccaaggcacataccacacacaaacaaactacaccagaggcagaagcagagttagcaaagcagattcaagaagattcctttgttgccaatacccccacacaccccggaccgcaatgtccagggccattagtcagcggcattgtcggtgtgctttgcgggttagcagttataatcatctgcatgttcatttttgcttgctgctacagaaggcttcaccgacaaaaatcagacccactgctgaacctctatgtttaattttttccagagccatgaaggcagttagcgctctagttttttgttctttgattggcattgtttttagtgctgggtttttgaaaaatcttaccatttatgaaggtgagaatgccactctagtgggcatcagtggtcaaaatgtcagctggctaaaataccatctagatgggtggaaagacatttgcgattggaatgtcactgtgtatacatgtaatggagttaacctcaccattactaatgccacccaagatcagaatggtaggtttaagggccagagtttcactagaaataatgggtatgaatcccataacatgtttatctatgacgtcactgtcatcagaaacgagactgccaccacacagatgcccactacacacagttctaccactactagcatgcaaaccacacagacaaccactttttatacatcaactcagcatatcaccactacagcagcaaagccaagtagcgcagcgcctcagccacaggctttggctttgaaagctgcacaacctagtacaactactaggaccaatgagcagactactgattttttgtccactgtcgagagccacaccacagctacctcgagtgccttctctagcaccgccaatctctcctcgctttcctctacaccaatcagtcccgctactactcctacccccgctcctcttcccactcccctgaagcaaacagacggcggcatgcaatggcagatcaccctgctcattgtgatcgggttggtcatcctggccgtattgctctactacatcttctgccgccgcattcccaacgcgcaccgcaagccggtctacaagcccatcgttgtcgggcagccggagccgcttcaggtggaagggggtctaaggaatcttctcttctcttttacagtatggtgattgaactatgattcctagacaattcttgatcactattcttatctgcctcctccaagtctgtgccaccctcgctctggtggccaacgccagtccagactgtattgggcccttcgcctcctacgtgctctttgccttcgtcacctgcatctgctgctgtagcatagtctgcctgcttatcaccttcttccagttcattgactggatctttgtgcgcatcgcctacctgcgccaccacccccagtaccgcgaccagcgagtggcgcagctgctcaggctcctctgataagcatgcgggctctgctacttctcgcgcttctgctgttagtgctcccccgtcccgtcgacccccggtcccccactcagtcccccgaggaggttcgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcagcaacctcaggcacacgcactaccaccaccacagcctaggccacaatacatgcccatattagactatgaggccgagccacagcgacccatgctccccgctattagttacttcaatctaaccggcggagatgactgacccactggccaataacaacgtcaacg

SEQ ID NO: 316 - protein, 180 aa, Artificial Sequence; identical to SEQ ID NO: 162
  Synthetic Construct

SEQ ID NO: 317 - protein, 207 aa, Artificial Sequence; identical to SEQ ID NO: 163
  Synthetic Construct

SEQ ID NO: 318 - protein, 144 aa, Artificial Sequence; identical to SEQ ID NO: 158
  Synthetic Construct

SEQ ID NO: 319 - DNA, 5315 bp, Artificial Sequence
  pSh-HIV-short-gag -  based on HIV
  enhancer (350)..(610): Enhancer
  misc_feature (611)..(838): CMV\promoter
  TATA_signal (812)..(815): TATA
  CDS (934)..(2025): Gag\short
  polyA_signal (2178)..(2380): BGH-PolyA
  misc_feature (2453)..(2491): PI-Sce\I\recognition\site
  misc_feature (2713)..(3356): ColE1-Ori
  misc_feature (4030)..(4845): Kanamycin-r   complement (4030..4845)
ggtagcgaaagctcagatctggatctcccgatcccctatggcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcgggcgcgcgtcgacagagagatgggtgcgagagcgtcagtattaagcgggggagaattagatcgatgggaaaaaattcggttaaggccagggggaaagaagaagtacaagctaaagcacatcgtatgggcaagcagggagctagaacgattcgcagttaatcctggcctgttagaaacatcagaaggctgtagacaaatactgggacagctacaaccatcccttcagacaggatcagaggagcttcgatcactatacaacacagtagcaaccctctattgtgtgcaccagcggatcgagatcaaggacaccaaggaagctttagacaagatagaggaagagcaaaacaagtccaagaagaaggcccagcaggcagcagctgacacaggacacagcaatcaggtcagccaaaattaccctatagtgcagaacatccaggggcaaatggtacatcaggccatatcacctagaactttaaatgcatgggtaaaagtagtagaagagaaggctttcagcccagaagtgatacccatgttttcagcattatcagaaggagccaccccacaggacctgaacacgatgttgaacaccgtggggggacatcaagcagccatgcaaatgttaaaagagaccatcaatgaggaagctgcagattgggatagagtgcatccagtgcatgcagggcctattgcaccaggccagatgagagaaccaaggggaagtgacatagcaggaactactagtacccttcaggaacaaataggatggatgacaaataatccacctatcccagtaggagagatctacaagaggtggataatcctgggattgaacaagatcgtgaggatgtatagccctaccagcattctggacataagacaaggaccaaaggaaccctttagagactatgtagaccggttctataaaactctaagagctgagcaagcttcacaggaggtaaaaaattggatgacagaaaccttgttggtccaaaatgcgaacccagattgtaagaccatcctgaaggctctcggcccagcggctacactagaagaaatgatgacagcatgtcagggagtaggaggacccggccataaggcaagagttttgtagggatccactagttctagactcgagggggggcccggtacctttaagaccaatgacttacaaggcagctgtagatcttagccactttttaaaagaaaaggggggactggaagggctaattcactcccaaagaagacaagataaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcattatgggtattatgggtctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttgatcctccggcgttcagcctgtgccacagccgacaggatggtgaccaccatttgccccatatcaccgtcggtactgatcccgtcgtcaataaaccgaaccgctacaccctgagcatcaaactcttttatcagttggatcatgtcggcggtgtcgcggccaagacggtcgagcttcttcaccagaatgacatcaccttcctccaccttcatcctcagcaaatccagcccttcccgatctgttgaactgccggatgccttgtcggtaaagatgcggttagcttttacccctgcatctttgagcgctgaggtctgcctcgtgaagaaggtgttgctgactcataccaggcctgaatcgccccatcatccagccagaaagtgagggagccacggttgatgagagctttgttgtaggtggaccagttggtgattttgaacttttgctttgccacggaacggtctgcgttgtcgggaagatgcgtgatctgatccttcaactcagcaaaagttcgatttattcaacaaagccgccgtcccgtcaagtcagcgtaatgctctgccagtgttacaaccaattaaccaattctgattagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagcttatgcatttctttccagacttgttcaacaggccagccattacgctcgtcatcaaaatcactcgcatcaaccaaaccgttattcattcgtgattgcgcctgagcgagacgaaatacgcgatcgctgttaaaaggacaattacaaacaggaatcgaatgcaaccggcgcaggaacactgccagcgcatcaacaatattttcacctgaatcaggatattcttctaatacctggaatgctgttttcccggggatcgcagtggtgagtaaccatgcatcatcaggagtacggataaaatgcttgatggtcggaagaggcataaattccgtcagccagtttagtctgaccatctcatctgtaacatcattggcaacgctacctttgccatgtttcagaaacaactctggcgcatcgggcttcccatacaatcgatagattgtcgcacctgattgcccgacattatcgcgagcccatttatacccatataaatcagcatccatgttggaatttaatcgcggcctcgagcaagacgtttcccgttgaatatggctcataacaccccttgtattactgtttatgtaagcagacagttttattgttcatgatgatatatttttatcttgtgcaatgtaacatcagagattttgagacacaacgtggctttgttgaataaatcgaacttttgctgagttgaaggatcagatcacgcatcttcccgacaacgcagaccgttccgtggcaaagcaaaagttcaaaatcaccaactggtccacctacaacaaagctctcatcaaccgtggctccctcactttctggctggatgatggggcgattcaggcctggtatgagtcagcaacaccttcttcacgaggcagacctcagcgctagattattgaagcatttatcagggttattgtctcatgagcggatacatatttgaatgtatttagaaaaataaacaaataggggttccgcgcacatttccccgaaaagtgccacctgacgttaactataacggtcctaa

SEQ ID NO: 320 - protein, 363 aa, Artificial Sequence; identical to SEQ ID NO: 169
  Synthetic Construct

SEQ ID NO: 321 - DNA, 26 bp, Artificial Sequence
  pSh-HIV-short-gag -  based on HIV
  misc_feature (1)..(26): I-Ceu\I\Recognition\Sequence  (5298...8)
taactataacggtcctaaggtagcga

SEQ ID NO: 322 - DNA, 2128 bp, Artificial Sequence
  pSR5 - based on E. coli
  misc_feature (303)..(891): pMB  origin of replication
  rep_origin (304)..(304): ORI
  misc_feature (1062)..(1925): AP(R)  complement (1062..1925)
aattatttaaatcccggggatcatcgatgatctctagagatcactagtctaggatatcatttaaatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaag

SEQ ID NO: 323 - DNA, 2171 bp, Artificial Sequence
  pSR7  - based on E. coli
  misc_feature (346)..(934): pMB1\ori
  rep_origin (347)..(347): ORI
  misc_feature (1105)..(1968): AP(R)  complement (1105..1968)
aattgtttaaactacgtaattaggccggccgcgcacgcgcatatggatcgatcgctagcgatcgatcgaattccgcgtgtcattaattaagctagatatcgtttaaactatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcttcaag

SEQ ID NO: 324 - DNA, 3615 bp, Artificial Sequence
  pBleuSK I-PI cassette  - based on E. coli
  CDS (818)..(1678): Amp-R
  polyA_signal (3254)..(3456): BGH-polyA
tatcgataccgtcgacctcgagggggggcccggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctccaccgcggtggcggccgctctagaactagtggatcccccgggctgcaggaattcgatatcatttccccgaaaagtgccacctgacgtaactataacggtcctaaggtagcgaaagctcagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcggtacgaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcattatgggtattatgggtctgcattaatgaatcggccagatatcaagct

SEQ ID NO: 325 - protein, 286 aa, Artificial Sequence
  Synthetic Construct
MSIQHFRVALIPFFAAFCLPVFAHPETLVKVKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRQIAEIGASLIKHW

SEQ ID NO: 326 - DNA, 89 bp, Artificial Sequence
  ICeuPISceI cassette based on Saccharomyces cerevisiae
  misc_feature (13)..(38): I-Ceu recognition site
  misc_feature (26)..(27): cleavage point for bottom strand
  misc_feature (30)..(31): cleavage point for top strand
  misc_feature (39)..(77): PI-SceI recognition sequence
  misc_feature (49)..(50): cleavage point on bottom strand
  misc_feature (53)..(54): cleavage point on top strand
gatcatcgtacgtaactataacggtcctaaggtagcgaatctatgtcgggtgcggagaaagaggtaatgaaatggcacatatggatcta

---

The invention claimed is:

1. An adenovirus having a capsid comprising a hexon protein, a penton protein, and a fiber protein, wherein said hexon protein is the hexon protein of SAdV-A1309 with the amino acids 1 to 939 of SEQ ID NO: 96, and said fiber protein is the fiber protein of SAdV-A1309 with the amino acids 1 to 425 of SEQ ID NO: 106;
 said capsid encapsidating a heterologous nucleic acid comprising a gene operably linked to expression control sequences which direct transcription, translation, and/or expression thereof in a host cell.

2. The adenovirus according to claim 1, further comprising a 5' and a 3' adenovirus cis-element necessary for replication and encapsidation.

9. The adenovirus according to claim 1, wherein said penton protein is the penton protein of SAdV-A1309 with the amino acids 1 to 540 of SEQ ID NO: 91.

10. A vector comprising at least one simian adenovirus nucleic acid sequence selected from the group consisting of:
 (a) the open reading frame for the penton of SAdV-A1309, nucleotides 13897 to 15516 of SEQ ID NO: 86;
 (b) the open reading frame for the hexon of SAdV-A1309, nucleotides 18348 to 21164 of SEQ ID NO: 86; and
 (c) the open reading frame for the fiber protein of SAdV-A1309, nucleotides 32137 to 33411 of SEQ ID NO: 86;
 said vector further comprising a heterologous gene operably linked to expression control sequences.

* * * * *